United States Patent 9,567,581 (SELECTIVE REACTIVATION OF GENES ON THE INACTIVE X CHROMOSOME) - sequence listing, part 36

SEQ ID NO: 4456 - DNA, 1034072 bp, human
acactagcaatggcaaagctttgtgcggaggcattgctggctgctctgaactaaaagcatccgtggggaccgaaagaggtttttgcacaccttattaaggtaggcaagtgtgtctgagtgtgtgtgtgcctaaaagctggaagacatctgttgagaggaaagtgctcttctgtgggtctggcagcttttctgtaagtcttctattctgatgcaggagcgtgtgagcagtgggtgggaggagatgctttggtacttggaatgctgaggtccggattaagtggtattgtaatagctagttagaggcagaataaaaagctgggaatcaaagcatttaaaaatgcatccttccattatttgctctcaagttaaaccatattcattctaggggaaattaaaaaaaaaaaaaaaacacagcaagggcaagtagcccaaatctgtaaggtctttgagcttctctgttcgtccagcttttgaagtcttcctacagccaatttgtttggctcctctggagggggcaattcatatccacttccctctcctggagcatttctttcttctatactccatcagggaacaatagagtttaacagtaacaggcaattttttttttttttcaaagcttgtgccctcttctgcgtttaaaggtgttttttaagagactcctgctaggggaatcttggcgcctgtgtgttaagacggcaattaacttttagtatcagtgcttacattaaattttctctctttctgctttactaaagcagtcattaaaattcagtgtgagtaccatgaaactttatcataaaaccctgctttgcttagagaaccttgattgttttctgaaagcagccttctcagtttatatatacatagctgccttccttggaatatcaaattgctttgtgtcacattaagaaacactaggttgaacctctatactgtgttttatctgagaaaaatactactgcaaaaagtttgatttgttcaagttttaggatgaaaatttctttgtaacaagttatttgagttgcatactatgtcatcgtatatctctttagttcaagtaattttgcaattaacatacggttatgtaaagaagataatgatttattttttatttatatttttaaaagttattaagtgaggttttcctttcagtaagagtttagaaaaaatagccagaacaagtaactggacttggaagataaagatacctttgcacttctaaattttacctttgtacacttcggttgtgatttaatcattgaaatgcctctgctttgaagtaaatgcatcacttatggtgtatgctgtgttttaataaagggaaaacagttatgggttctctgttgcacatttgaatgttgttattttttgctgtatttaataacctcttttttctcttgtgaggtttactttggaaatgaggcatgttcaaaaataggctgacattcagcttctatgttttaaatttaaatgctgtctgtgttttatcacatctggaatgtgtggggagaaaagataccaagttttattatttagatttaattgtagaattgcagattgatatttttcaatgcattttcattatagtttctgccatggaggcagcgtgagggctttcaggaagatggagtggtgtaattaccaggtgcgcacgttcattaatccttcctggctagagaaagcttcaagttcttctccagtggcccattcgtaaagctataaatatctaaattgtgtcagccaagaagtcacacagaatggtggctctttttgagttcaatttcatgcactgttgctttggtcttgtgaggaaagctctgaattccttaggatagtcttggttgtgaagttccaaaaacaaaatatcaaatcattaaggatttaatttaaaatacatactcttctttcacaaactagatgattgcagtaatgtggattataaatttttttttttgctttatttctttagagctcctctttttattttgtatgatcaagattatagctgagattttggtgatttttttaaaaagatttatggcttatggtccatcagtctctccactacttcaaacctgtgtacccctgtatattatctgcagtactggaatgtttgcattgtatgtggaagctatatacgatttggtaaaaaataacacttaaaggtcttcgctaagagtgcttatttaatcattaaatatcccttaataaaaataattccagagatattgtctgtgtacaaacttaaaaaaagagaaatataaaatactgtgatgtgaataaaatgtatagcaatacactccaataataccattcttatgttttcccttgttctcaactgaaataactaagctaatagagacgtcagtaaggaatgtgttgtttcttcataatacaactacaaactcatctgataagaacaacctgagagtgaacgttaactttcctcattagaaagattcaatttaacacatatatacaaatacatttttaagataatgatatttgcagagtttttgtattctatggagtaaaggagaattatcacatattcaaagtaaaggtataaaatacatcttaatgttttacttaaattttaaagggtccaaaatatactaaaattgtttttctaattctttcctatgtttaaacgtgccagagtcattggaaataggacattctttttcttaagaagattttgcccaaaatatttaaaactattttcttttcccttgattttacaatttcaatattcatggatttttctactttaaaaataacagtagtttttatgatcttaaaacaaatgtttaagggcactttcgctctctggagactataccatccacatatttattatcagcaaaagaaagggcagggcatacttttatttgaagttgagtataaaaatgtgtctgtgtgtgagtgttattaaaaagataagtgaagagacaaatatagaatccaggaacattttcagcctggcttttactctctctaaaaatctaatgaaacccttgagcatctcttatctcaaggtacattaggaactgtccaacactatgatccgatgggagatcagtatattcatataaagaagaaaatttgttgttagtgaaagtcaagtcttttaaaaaaataatagttacagcatttgcaatatacaagcataatagatttactcaacgcccaccccccatctttaaaaaatcaatttccgacagttgtctactttaaaattgaacatatttgctacctggagggaacattgtaatgtagcccatatgtggtatgcatcctgaagaaaacctgaaattatagaggaagttatcctgccttctttcttctgttgaatgagttaaaatatattaacaatttgcctttcactttgtatttatcattttgtatctttgcatatttacatatacattcatgtgtacaagggcatatatactcacaggtcagggctatttaaacagctatttatttgaatatgccagggaaaatctccaagatataaagaagcagttattagatactatgtcagtatagaattaacagccatcttttttaagatggaagagaaaattaattaattacatacaatttctaacctcaagacattttctttctggagacaaggaatactgaggtgctcacgatagtgaagactcaacaagaccctaataaaatagatgaggataagtaaaactacaatagccaataaaaaacaaaaaacaataaaccatgtttcgctggcatgttggtgagtatctctgtaatatctgtcaataagggtctctgtagatttggagtaatgttcaggaactacctgtactagagaagacagtggagaggactccagtggctaaattctgctgcctttgcttccagaaatgtaaataataaggaggtattgtggcatttcctggaagcagtagtcttgtttcatggtctgactgtataagaatgcctagagaaacataacctcagctgactaaactcccttgatgattgtcactttgtcactgaactctgaccataccttttgcctccagaggcaaaagacgggtgaggaagtgatctcctcatctggtttttaaacaagtatataactagagaactggattatctcctaaacccactcttgtccctggaaaaaggggagtcatcctatccgtttcttagccaatttatgtatactcttagtttgagagcatgagaaggaaaactattttcttttcttaccttggctgggtttttaagaatttatttttagtttaatcaaaataatattttaaaaggtagtaagcctctcataagcagtttgatctgttctaaaataacttcaatttttctttttttaaactttcttttatcttacacacaaagtataatagtaatatgtactcactagaacaaatgaaacaggatggagtcacatagagaaatatatcatattctccctatcccctcccttaatattaacatttaggtgtcatgtgcttctccattaattttcattgcaaaggcctaaattttcttccaagagtgaggagtagcagcacggtagtttggacctgatatagctctctttccctagccttttgcttaagtgctttcctaggggctgactttacttacctaaagatgtttcaagcaagggctcacatttttggtagcagaagacacttactgattgctctcactaataattttgaaaggaatgtcaaaatctgggaggatcatgaaagaaatatcagaaatttcctttcagctgccattctccttaatactgttatcaataaattcagcatctcatatgtgatagcaaaaaaggtgctgccttttgttcttgcatcctgaggttcttacctaataccatggtagcaataaagatggtgagaaaattgcttcttctatggtgttcaggtcctgaacgagcaccctcacctccacagacggtggcaggtattcaagcattttacagactttggagttaaatatagcagtgttattctaatttaggtatgccaccaccagcggcaccggcaactgcaataggaaaaatgattggcaatgccagctatctgatgttttcatgtgccaggtgctgtcagttcttcacagtattacattccatcctcacaacaagagagtgccagtgagtgttgctgtgtgccagtgcccaggctaagggctttgaacacattaccctgttttatcctcataactttccacgttatttttattcctgaatgaagaaacaagttctctgtagagatgctgtcattgatccactcatatcctttcacatccgtttaacattttccctgctgtgcttttactcccaacaactagctccctaatcgctctgttggagggtggccttgaggctgccagagcctatttggtctgtgtaaagagagagatggatctatcctggaatttatgtccctgtgtgtgggaagcccttaatcaatgactgctggttgcagacacataaatacgtgagctttcttgttcccaactgagaaattcagaagtgtgaatggcactgccaccctgggcttttatgccatatatgtgtttggtctgtttcccttcccaatctcacttcattttcccttaccagtgtttcttgaaaacacatcccattagatcatttttgcatgaagcttcatctcagaacctccatttagggaacccaaactaagatattctctaaaatagaaactttattgataaagtttccaaactgtcttagtagatggccaatataagaccaagccaaatctttctgggtccaaattccctgtctttaattaatagactccattacaacacattcttcaatctttagtcagcaaacacttaccacgtgcctattttatggcatattatatttataccatagttaggatattatggttcatgaatattttatatctgtacacctgaaattctattgacctctctgggccacagttttgcatctgtaaaatcagcacaataatgctacttatctcatagagtagacttaaaaacgaatgaaatgatatatgccaagtgttgagaatcacaattggcaattactcatgctcattaaatattagctgtttttatgagtattgtttcattttcggtgcataatatcctatgcaaagaacaaaaggtattggtataggcattgaaacttgaagcatagaagaaaaagttaattaaccggtgccccactagatgcctctaactgctggctccgtgtatccctttagccttggctcgtcacgagaaaaccttggagacatttctgctggactcagcagatcaatttaagaaagatgaatgacatttttcttgaaatgtattcagtcatagctgcctttttctactttcatattttggagttcttagaaaaaattaaggactcctttttttaaagaaaatggtataaaagaaaatgcatatcactttgtcactttattattgtaacctcatcaaagtattcagtgtaaagacagtagccaagtgaactcttcttgtaatgctcggaaaccattttagcaatggtaaaattgctgcaatttatattcgtcaaattgcatgatttgacttattttagaaaagttattaacttctgaagagaatgcttcagaagcatttaaatgagtacaagttatcaccagtgatatacataaatttcatttcaaaatatacttctagaaactgtacttagttagctatagtatttgtacaaggattaattcctatttcattttgtaggaatttatttatgaatgtctatggcctgccagtgtaaagcagacttagagcatcatcttttacaataatctttttttttttaatcaaaggggagatattctggtaaaacaaaacaaaacaaaaacaatagtttattctgcatttttattaagtccctctgtaagtcatccctgaaatgggatatgtagagtcttatatttatttatttctcagaagcttattggaggtgatatgaaggattttaagaccctactaactaacaaaacaacaatttaaaattaattttcaaaataccttaacaaatcttattctccttattttcaaattctttaacaatgtttttcttattactaacataatatcttctgatgtagtcataataatatctaaaatgacaggtctaagtaacttacatggattaattgagtcttctaaatagtaaggtagatggcactattacttctatatgagaaatgaggaagtagaggtataaataagaaattttttggccgggtgcggtggctcacgcctgtaatcccagcactttgggaggccgaggcgggctgatcacgaggtcaggagatcgagaccatcctggcgaacacggtgaaaccccgtctctactaaaaatataaaaaattagcctggcgtggtagtgggtgcctgtagtcccagctactcgggaggctgaggcaggagaatggcgtgaacccgggaggtggaggttgcagtgagccgagatcgcgccactgcactccagcctgggtgacagagcgagactccatctcaaaaaaaaaaaaaaaaaagaagaaatttttttgagtgtatacagttagaaaatggcaaaatgggaattcagacccaaacagtaagactcaaggatacctttcttatcagtatgctaatatgaaaacctaagcatactagaaaatctaagtgccagttggaaaccagaattaacattttggtgtgtaactttctggctgctttttctatgctaacaaacatatatgacatacaaaaatacacacatacacaaattcctgttcactacttcttttatgttaacatcacaatgtaccgtacacagctgtattattttatatttgatttcatattttttctaaagtcagtgtatttgtcaaatatcaacttatctatttaataggaatatgggatgatctttgcttatacatacatacatatgtatataaaaacaaaatcaagtattttaagcgttcaccagaagtcatatgtcaatcagtaaagtatataattttttgctgccaatgacatatatcataaaaacgctacctatcatagaatgaaaatgaaacacagcaatattgggacacctattctcaagcaacagctttgtgatttattagctatctcacatgaaataactcattaacttggtattccaagcagcaaaagaaggatcacttaggtcacttgcaaaataatacaaagctaggtttaggggtgggttgcgcttggtgggatgtagatgaaaccatatgggcccttgagtttataattgctgggatctgcatggtgggtatatggatgtttattacagtatgctagtgagttaagaaagaagaggaattattattgacttacatcatagagtttatgcaaaaattaaacgataatttatttttaaactctagaggtataggtaccatcatgaagggacccacagaactgatgtagccagtaattattggagctggaacagatactctgctgtcagttgttctggttttgtggtcattgttcttgcctttgcaagttaccaactctaagaccttgggcaatactttaagtcttggttgtctcatctgtaaaatggggagagcagtaagtgtcttaaaggtttattctcatgttatatgacttacggtatgtaaaacatctgcgtttagacacatagagggtgcttaatggatgattgctctcattattaggctacatctaatctatgaatttaaaaactgtatagaaatatgtgacagattctttaagagccaaataccaactacagtgaaaaatacttaacacttgctgagctcttagtatgtgtcaggcttaactaccttaatgctcatagcaatcctataagataggtactcttgttatcctattttatatcttctaaaattgaagcaagggaagttaaataataggacaaagatcatacgctatctatccatatatacccatctggctgtctacctgtctccttccatccatccatccacttattcatctacccatccatccactcagttacttctctctctcccaccatccctttccctttccctctccctctccctgtctctgtcactctcctttacttatctatctatcgatggatcggtttatctatcatctatctatctctatcatctatgtatagttgttaataacactaacattttataaattacaagactgaaaaatgttttcattaacttatggtaacaaaagaccacattgtgaataaaaaaagcagtaaacacaggtctctgcacatatgaaagagatgtcctaaacaggaagagatgtcctaaacagtagggatacatagtatcatacaatcaaaacatggcagccctataaaacttacaaagcaatttcatgtaagttatttcatttgactcttaccacaatctatgaggttactatttttatttttctcattttacaggttaaatttaatatggcttccaataaaaaattagtatggttaataaatatcttgacgtcttgctcctataatcctaccgatagtttacagtaattagtaaaataaaataataggaaaaatacctttgatactagtattaaattataatcatatcattaggtaatttcaatttgtgattttcaagaatctgtaatatggtagcttcttcctactgacatgtttgaattcattttaaggcttataattcacaagtaatctatatattatctaaaatgtaaatgcacattcacatggagataataaattagcgtgaaatggctgtattttgctctctataatttttaacatacaggaaatcactgttgtctcaaaaatcaaggaaatatagtatttgaggtgaacttattctttctactattaacacattttaatatagttctctcacagtgcaacagagcaagaagctttcagacacatttgctgctgcaaggagcatgctgtgctgaacttaaaacaccttccctttcaaactccttgggactgtttttttccaagagacttcaaatgcactaaatttagcatccgttggaggcacacccaggcatattatagtgaaagccccaataactgaatgtgttaccactattcacaatgtttatgtgtgtatatgccttatctatgatgtattgcaaattacaaaaattgtgttattattcacagtaacaaaaacacttccagcaaatttctaacagtgatctcttttgaaataacttacatacatgtgtcatgggtcttaaactttgtcacttttatgtttccatcatgttgttttagccagtgagggttttgtttggttttcatttatgattatatactttcaaaaaatagatttcaaagtgtgaatttgattgattgattgactgattcattgagacggtgtttcactcttgttgcccaggctggggtgcaatggtgcgatctcggctcaccacaacctctaccacccaggttcaagcgattctcctgcctcagcctccctagtagctgggattacagatgtgcaccaccacgcctggctaattttttgtatttttagtagagacaggggttcaccatgttggccaggctggtctcgaactcctgacctcaggtgatccaccctcctcagcttcccaaagcactggaattccagacgtgagccaccgcgcccagcccgtgaattttatttttgaaagacaagaatgtccttgcctaattgcataatagtttaacatcatgaagactaaatatgctttttagccatgacaattttatttattattgttttcatttttaattttctcaaagatcctcatcagtgtactctttttggtcttccttataagcgtattttaacaggacataataataagataaatcccaactttttaaagttgtatccgtatgtattactttaaagtgctattaatataaacgaattagaggcaacttttattcaatcagattttaagtaattttaccaaaaatatggccttgataatgtctctgtaacaggttctctgtaatatacatgctgaggattggtttgtctttgcttttgatactattttaattagaaaagtaatggggaatccagacccttctcatttaataatccagagaaaaatcagtccatgttctaatagtttaaatttttctactaaaacccatgtgagaatccatatgagtggaatggagaggagttcagcttcaaagttggcagatttgagatgattctatggcaacagaaatgtgcttgagggaaatcagttgcggcatcttctataattgtgtcacctagattttgccttaggaatttctagatttccatagaacattgtgacctcaaatgctttatcttaataaagaaataaaagcagattagaagaattatttgcctacagtttgtgggagatgggcaagtcttaagagtttattaggtacccagaacgaaacatattttcttgggcctcataatcacattgaaatacaaggatttagttatacacagtgaccagttagtgaatgacagtcttcagtatctagtagacagtaaacatataaagatgtatttgtggccgggcacggtggctcacgcctgtaatcccagcactttgggaggccgaggcgggcggatcacgaggtcaggagaccgagaccatcctggctaacacggtgaaacctcgtctctactaaaaaatacaaaaaaaaaaaaattagccatgcgtggtggcgggcgcctgtggtcccagctactcgggaggttaaggcaggagaatggcgtgaacccgggaggcggagcttgcagtgagcagaggtcaggccactgcactccagcctgggcgacagagggagactccatctcaaaaagaaaaaaaaaaaaaatgtatttttacttttaactacagcgagagaccctggcagcctacagcatacaattagtgttcattatttagattgcatggatttaatgtgaggggtcaattacttgtctaaccagtgagcctagcctcttgctcaatactgcctgcttcatgagggtgaactgtgctggagaaatatattacaggattatctgcagattttttttaaatgagtggttaagtcaaaagttcttgtgaaaattcagagtaataaattattatgaagttgtgtaactaggtaaaggatagtttcttttacacgggtaaagattaacatgaggaggaaaactttagcaatggcatttaattccattcaatatatttatattgagctcctttaaaaatacagggccttgtggtgggtgctgaggacagaacaaaaaccaagtaatacatgaacataacccttgatttcatgatctagtagacctataaaagttgtcgatatctgatgaaaagaaaatggtaaagatattccaaacagtgtatgcaaatccagagataggatggaggggctctacctgaaggatgatgataagaaaaccgtgttgagtgaagggtgatttgtggaattcagataaaatatcagtcttgaatgctgagtgaatactcaatgattgactagatcccatggacagtaatttcttcaattatgacgatgctagtgtttatgactataactatcattctccatgccaggcactttgccatttggtaaatgtatagtgtgctattctaacaagcatgcacagagcttttactttaatgtatccatgagtttattggggttcagaatttaggtaagctttgcaaggtcgtagcatggagtaaaatatctgaaattcagacccatatctaactaagttcaaagactgtacagatatttctcctcctttgtgcagagaaggataggaatggttccatattatcatggacttagtcagatgttttaaaattataatgtcctgtgttaatgaagaagggatgatattcagtgcatattcttaaccgttactttgcttaatgctctcgacttttctgtgagatggatagtgtagataaaatccccaaggggactcagcaagtgcaagtaaaacaatgaaactttaaagccctttgtcaaaacctctctttttctcagaggatggaagggccgtaaaggttggtgaggaaggatggaccatttcctatgtagtcttctgacaatattcaaacaaaaggagagtcagcaaatcccccttgatgtgggaagttttaatacaatttgcagagtgtctctctggagtagacatcctcctctgcaatcgtgtcttctatatagcctcagggctttgggtaggtaatcctctccaaggagagtcctggagagggctgtctaccccccttgcaccatcctctaacattattctatagctcagctccttgtttctgtttcctgccttgtttttgtctgagtctgcaattatgatgtaagcaccatgaaggaaggtatgttgccagtgtttgcatcagcatatcccccgtgtgtagcagcgcaagggatatagtgagccctcaatgtctatttgtagaaaaaagaatgaacgtatcaacgaaatctgatacatattcattgtgtctgttatctccatctctcttgtcctgccttgttatcttgccattttcacaaaaggccccaaggcccatcatttcttgtgtaacttccagagtgttaatttttaaattaaaattaaggctttctacatgagtgtctattatttgagaaaccatgcaagatcgtgtgtgtgtgtgtgtgtgtgtgtgtgtgtgtgtgtgtgtgtgtgttgcactctatattatattgaattctggattttttcttataaataaaattttaaaaatagttctttaaaaataggaataagatgttttaggaggcacagagagcaaaggagaataaaaattgcaggtttggggttgtgcatactaattgccattgagtaaagagagcacactgaggccatttagaagagaattaacgtgttttgtttttgtttttgtttttgtttttgtttttgtttttgttttgagacggagtctcgctctgtcacccaggctgaagtgcagtggtatgatctcggctcactgcaacctccacctcccgggttcaagtgattcttgtgcctcggcctcccaagcagctgggattagaggcgcccacaaccacgccaggctatttgttttttttttttgtatttttagtagagacggggtttcaccatgttggccaggctggtctcgaactcctagcctcaagtcatccacccgactcagcctcccaaagtgttgggattataggtgtgatccactgcacctgaccttatttttattcatttaaaaatattaaatgttactgcatagggagtaatgggcttaacaatgaggtgaccaaaactcctatgtaccatgcagagcaatgtatcaaatgtttttaactataaacttctcaaaaacataaacctaattgttctgcagctgcaggttatatctgccttgtttgagcaaaatttggtggtgaaaatgccttgcttccatttttccttcaataactgatatggtttggctgtgtccccacccaaatctcatcttgaattctactcccataattcctacttgttgtgggagggatccagtgggaggtcatttgaatcatgggggcggtttcccccatactgttctcatggtactgaataagtctcacgagatctgttggttttatcaggggtttctgctcttgcgtctccacattttctcttctgcttccatgtaagaagtgcctttcacctcccaccatgattctgaggcctccccagtcatgtggaactataagttcaattaaactactttttcttcccagtctcaagtatgtctttatcacagcatgaaaacggactaatacaataacctatataattttgaaaagtacttgtctaatagactttcacaatagaaactatatccttatcaactttgaaaagtcattgcttaatgcctttggataactgaattttctaagattattttaattttgaaagttaaattttatcccagtgttgacgatttttgtatgctacttttaaaatattttgtcagtgatttatatctatggtgcaatcttgtaaaaaattaacaatgcaaatgtggctagaccatttaaaaatcaatatgttataattcagcccatttaatcactttagttaaacatcttaggaacaactcagttccatttgagagaagacacagttttctagatgtgtgttgtggcatcatattgctttacaatatcttacataaggtgaattcaaatcatatcattgaatctgttttaaattctgtcatagcttaagattagtgactaaatattggcaggtttatggaagtaggatgtaaacaagacaaaaacaagggtggaacaagtaattttagtatattattcacttgcacagagaaaagtcattcacaccttcttcagctttgtgaagaaaatagactaaaatcctgttgatatagcaactatgttttccgtttcttgtataaaaataaagaaaacttcctattaggaattagccagacattttaattttctctcttctttctctattttcccttacagtctctttgaaggcaggcaaaatttctataaagttttaagaatgttttaagatttttttattgtgaaatattcatagactcacaaggagttgcaaaaacagtacagagatttcctgtgtatacataacccaactttccccagttacatattaaccaaatacagtatattaccaaacccaataaactgacattggcacagtgcaatcaactagactgtagaccttacttggatttcacctgtttttgcacatgctcttttactgtgagtcattatctgttattctatgacattaaccatgtctatagatttatatagttactaccactatcaagataaagaagtgtttcatcaccacaaagtaacttaaaggattatttttataaagtaatgacaaatgtgtcaaaagccattcctgtgttatatagcaagtatgttttgagttattaaaactcactgatcatgtctttcagtgtcataactttgggtttccctccctaactataataatcctgatgaattacagttgatgaatatgagaatatccaactcttcctgactctataaatatattgactgagattgtaatatttatggtgtcttaaggggcgcttgttttattatgatgatgtgaacatgttgagaatagtaagaacagcccagtttagcaaacaggatatgagtcttctatatccagctcaatcgttgccccaacaggggacatctgcctttgctacttaattttccattctggaaaatgtgaagtgtatgagaatgaataatcgtctccgattttccagcacataataatctgaggagagcaggtacagcaatttaggagctgttttcttttggtttccaaaaaaagttccgtccagtggtctaagttagtcgtttactaagtgatagagcaattggctatgctttttgaacggactgataattatgtggatgcagcaaataggatatagacaatgcatctactccattacagtaaaaaagactctgatagcagttaatccacataccaggcacttagcttaggcacagttggaggaaatggaatggtaatagactgtagtatggcatgacaggagctgtagcttgagattcagaattccaactctgcctctcaatatttgagtcctcatggccaagatatgtaaagtgctctgtgcaggtcttggcaaccatccaccacacacttagtatgcaatatctatctttattagtcaaggatctggaaagctagttgatgagacaaatgatagaaacaagagttcattagatgaaataaagtaataaatgatgcaagaatttaaaaaagatttagagaaggaaagggaacagaactcacatgcaagtagagcaactgtgtatcagataatgtgctagctgagttagaaaccatgtctcatattaccctgaaaataattctgcaaagctgtaggtgttatttttttcatttgacaggtgaattcatgaaggcttgaatatagggttaagtgagttgtttcaatgtagttattgattcaaatcaagatctgaatgactctaaatatggtgctatagagatttgaagtaggataaataggatttgaaaaaaagaaaaaatatatagggaaaggaattggtacactgtagcagtgtcataaatgaagcttcagttgtgtgattccagatgatgtatgtgaggcctaatcaaacagctttgtggaatcaaaatttctgctcttgtctccaactggggacgagttggctcgggattaaggtgggcgaccttgggaagactagagtctaagcaggactttagtccctcataagaattatatgaggatgtatatttgcatacaaattcctgggcccaccgagatctgccaaattggaatgtgtggtgatatcacccagggaaacatagagagctgttataattagtcatgaaatatttagtactgaaattatagattatgttaaataatcacttataggggacatagcagggttggcaggttaaccatacagcaaacagggttgtaagtcagggcctagagaattttcaagaggcaggaattctgcagaatgaaggcctggtctcatgcagcaccatggacagctccgaggcactcttgtttctccaaaaacctgaaatcaaaaactttgcttttcatcatgcaacatacccatgtaacaatcctgcataggtactccctagtccaaaattaaagttgaaaaaaaaaactatactttcatttgaatacagttctcttcggctttaccagctctactctggaaggaatatcttttactcaatgaaaggccatcccctgttaatgcctggccaggttctccttatcagtcattcactatctttgtgtgtgagtgactaaacatataatgctatgtttagtggatggagtaagattacctttgcagaggttgtactggcttacccctttggttcttgtagttttcttctattagagttttttccatccctaggtttctatactgttcaaatgggtttaagattcttgaaggtattcctctgaccttgtaatttatgcttgtctcctagcacaacttttttttgtaaaggaggcaccaactatgtggtttgctggcgatggcatacacaaatcaggtgggaggaattaatgagagcagcaattccaatatctggttcttcaagattaacttgtatagtttaattcagcattctaaataagcctcatagatttaaaaatctagaataaacccacatttttaaaaaaagttttatgttatctgtgctgataatgcacgctgtacataataaaatattattttcttttttttaaatttattattatactttaagttttagggcacatgtgcacaatgtgcaggttagttacatatgtatacatgtgccatgctggtgcgctgcacccactaactcgtcatctagcttaaggtaaatctcccaatgctatccctcccccttccccccaccccacagcagtccccagagtgtgatattccccttcctgtgtccatgtgttctcattgttcaattcccaatattattttctaagtggcagtggaagaaacatggaaagttctacttcatccatcggtggattagaatttgtataccatgagatgattaattttcaaaaccagtttgaatctcacaaaataatgaccctgttttttgaaggacaaggcagaacaaggaactaggctgtgccacgttcaagtcacaatctctaacatttgttttgttttgttttgttttgttttgttttgttttgttttgtttaatctctgttgcttgttcactttctcttgtaatctgcattgatttgctacctggctatttgtagattgacttcggctgccaggaatggaatgtttttcataaaggaacatatgccttaatgaaagtaccataagaagggagtagagtgtgaccaattgcctaggtaataagtagtgacaacaatgatattattctagtataaatggaatcagtttttctttgcccagggggcatgataaagaaggcctggctggtatatactaggtgggacacaccaacagtgcctagaatgtcaatggatcaaacctgagggaaccagaagttgaaaagacatatcccaaaagaaagcatttgatgtttaagggttggcttacttagaacacaatgaaaaatattactaaaattaaaactatgattttagctatttttaaatatgacaaattaaatagcagaacattttaataaaacattacttaaggtccacaattttctgtaagtctaatacatgggtcattaaaataaaaaattccccatgatttatggaatcagatttttttaatacaacgaattctaaatggttttataatgccaattccaattaatatcctaattataacatgtcatccagaagggttaatgactaaattttattaatatttgttttctatttattttgatttgtgcagtttatgtgtatagtaacgatagctgcaaattagataccattagcattaaataaggtatatattttaatagaaaattaaagttaagtatttgagctagcctaaaatattcaacaacttaaatttgttttttgtggatcacatttttttgagacaaagtcttgctctgctgcccaggcttgagtgcagtggtgcattcatggctcactgcctcaaccatccaggctcaggtgatcctcccacctcagcctcccgggtagctgaggctactggcgcacgccaccatgcccagctaattttttgtatttttttttagagatggtgtttcaccatctggtctcaaactcctgagctcaagcaatctgcccaccttggcctcccaaaatgccgagattacaggcgtgatccagtgcactcacccctgtgaaccaccattaaatagctaataaaagatgcatgtcaataaaaataaacaacttactagaatgattatgtgaaaatcatttattcttccaaagcatgaattttcaaacacaccttttgttactgttttaagaagggaatcatttccatatatttgcatgtaaatcacttttagtctcagagaactttccataaaagtttttttattactgctgtaaccgatagagctagtggactattaatttaaaaagctgtacataaaaacacatctatagctcaaataatctaggataccttttagtttggggaaatgtagatgaaaatgaagtaattacagaatccttgttaattttcagatttagacagtctaggcaatatctttcaggaatgaagagatatgtgttttttggcatcttggtagagtatattcccattgtaattcttttgtgaagtctagaccagatgtggccataaaaatagacccctactacaataatatatttcatagataatccaataaagtcaaatcttattgcagtaggcttagaactctgtttgcacccatggaatttatatcagtttttggcaaatcctttcatctctgaggatactttttcatctcacatataccctattttctgaacattttgccttcaaagtatacctcatttatcaagaatttctctttattcatctgacttatacaagtggcaataacaacgtctggttcccatgaagtaaccagtgaccctttgaaataatatagcgctggaagaaagaaaaggaaagggagactgatcattcagcaactctttaaaaccatgtcaccgttaaacacatagtttattttatcttttttttagaattgtgaaaacctatattagcatcttcacggatgtctcctttgtttacatccccgcttctgtgccttgcctgcagtagaaaaaaaaaggacatgtgtatccctattccccattgtcttctcattctacatgagaatgagaattcttttaatttcttctctatctacatgaacccacttccattatctgtttgttcagttctttaaatgccctgaagctagctctgtgactgggcagttgaaagttctggacttagcatcaggttaatttgaaaaatacttattgagccaccaccatatgtcagccactactgtagatgttttgaatgtgtcagtgaacaaagcagaaaagatgtatgccctctggattcttgggggtctcaaatagtgaaagacagatacgataagtatattgtatagtatgttcaaaagtgataagtgctgtgaaaaaaaagaagaagggtaaaataagagatggctcatgctggagtacattccaattttaaatagggtatcatggtattcttcattgagaaggtgacatttgagcaaagatctcaaagaatgaggcatggggttgaatcatgtagatatcagcagtaaactcattttgggttcagtaaacagtcaatgcagaattcctaagccatcggtttatctgctgtttggggctggttatctgcagtgtggctagagtgaagtaagtgagagaggtttaggagagaatgttagtgaggtgagggtggacctttgaagccattgtaaggacgtttttctctttctaagtgtgagaagatgatgctgactgagaccagggtgataagaaatagtcatattctgaacgtgtttggaagtggggccaacaaggatttctggatgaattggataaggggcatgggagaaaaatggagtcatgaatggctccaacgtttttgctctgattaactggaagggataaagttgccctaaactgaaataataaagactatagatagaatggggcgattagggaggcattaaatttggatatctgttagacatatcaccagatatattgaataggcaattgaataaatacctttagagttcagcaaaaaaggtccaggttggacgtttaaatttcggaggtgtttgtataagataacatttaaagctgtgatatcagattgtatcactaaggaagaatatagatagaaatgacaacgtgactaaggactctaacattaagaggtggattgacaaaggagaaaacagcacaggataatgaaaaggaatgatcagccaggcatggtggctcacacctgtaatcctagtactttgggaggccgaggcgggcagatcacgaggtcaggagttggagaccagcctggccaacatggtgaaaccccatctctactaaaaatacaaaattagctgggtgtggtggcacacacctgtagtcccagctgctctggaggctgaggcagaagaattgcttgtacctaggagacagaggttgcagtgagccaaaagattgtgccactgcgctccaacctgggcgatggagcgagacttcatctaaaaaaaaaaaaaaaaaaaaaaaaaaaaaaaagaaaagaaaaggagtgatcaatgagatgggaagaaaaacaaaagtgtgtggtgtcctcaaaaactgacgttctattttcaaaacctacattttgggtctccttttactatatcctgactttctagctatataaccaaaaggagaaagcagtaatttttttagatataacatgttaataactctaagggtattcaatgaatctgaataattcagtggtataatgtgaaaaaatatagtattcataggaaaaggaacagaagttagctcaggaaatgacttgaatgaacaccgaagccaaatctccagcgcaggtccacgtattatttgtctcagtggttgaattagcagcaagattccttagtaggatgaaaaaagatgttgtgagcatctgtatctacatgactgaattaaattcctccaacaatgaaatgtagttaacgtagtatctcgaaaagaaccctaagtggaattcagggaacctaaattccaaccatggttttgctgctgactgattgcattcacttcaaatctatcattaacctccttgtgcctcattatcctcatttcaccaaataagaaaaatgaaatattcctccttccctacctcactaggatgttgtggatttaaatgtgtgagaagtgcttgagatgcataaaatttgatggagtgttttattcatgaattcaaggcatctgaagtaatttgaccatgatggacagttgcttccttgcacattttttagagtgacatttccgttactgacccacccatttatgcaacatgttgcctaatctaaatttaggtcaaaacaaattgaccttataggtaagcattatatctattaatattgtatttttgtattattttataatattcatcattcacctattttctcatgcaatatatgttactgaacacatatagattaaaaagccttcatccctaaataacaatgatgggaccttccatttttatatccctctggcatttaaaatgtgcttttatagccatcatctccattgatctctcagtcccttgaggttgatatgacagatatgctttttccattttaaaattacggaactgacagtctcagatgactttaccctccaactactgtgtgaagaagcagggtctggcactgaggtcttctgacatccagtgtagagcactatacttcacaatatggccattggcttactttattacaagcactaaatattttccactgaatacgtaatacctagaggagaatgtcgtgtaaaacagcagcagtagaacagaggattaaatgacccattttcttgaagttatcttagttttaaagggttttttcttcatcactaatgaccatccctgactaagaaattattctcataatacatgataatatctgcgttttccaatgcgacaagaatgttaggatgtctatacatgatcttgacaatccctagctccatcacaatgtgtccaaattcattttatttggctagacaggcatgtagtcttactttcaatggttggctctgctggatgctatgtgatctagaacctgtcacttaccccttctaaacttcaggaattttttatccttaagataacaagaaaactcgtacctgtttcaaagagctgtttgttcaatcacctatccattgattatcttctatatgccaaatgtttttctaggtgctgaattacaggaatgaatcagaagcaaaaagttcttactctcaaggatcttatatgctaatgaaatagatgttaaaaaataacaatttttgtttcattttattttattttattttgttgagacagagtctcactctgtcacccaggctggagtgcagtggcacagtctctgctcactgcaacctctgcctcccgggttcaaatgattctcctgcctcagcctaccgagtagctgggattacaggcatgcgccaccatgcctggctaatttttgtatttttagtagagatggggtttcaccatattggccaggctgttctcgagctcctgacctcaggtgatctgccctccacggcctcccaaagtgctgggattacgggcatgagccagcgcacctggcattaaaaagtaataacaatttttaaatatcaatatgtcttatacagaaaagtgagcagtgtggtagagtgtaactggaatgtgagttgagacataacaccagacagagaagccagagaaggacttttgtttgaggaaatgacatttgaaaaggaacctgaatagtgacagaggcagatacctaaagaatatgttccagacaaaggaaacaaaaagcgtgcaattgcatagtcaacttagcctacttgaggaaaagtgtgagtggattttggtgatggagaggtaagtgccaggagatgaagggagagatctggcatgcatcagatgatgtgcagtcttccgggacgttgtaaagagttgggctttttttgtttataaattaaatgttaagccattggggtttttaaccagaggagttatgtgatatgatctatagttaaattatgtttgttcttggatggagtgtgcattatgggaatttatacagaaacaagatttcacatatatatatatataaaactcagtgtcaatagaaaataataaaaacaaattttatccattgataattctggcattgatagtagtgggtatggtggtaataattgtgtgtaacactcaaactttctgaaaacctacacttgatctgtaaatccaaaagtatatgtagcaaaagccataatctgctcttatttctgcaccacttgcaccagtgtggagtgataaggcaaattattcaggcacctgtgtaagccttcagtgtcctcacccccttgttataactctccactaatattacattggtaaagacgtccctgacctatatgtcactgagacctcaaagaaaagagcaaagctaaagcgtaagggggaaaaaagccagcttaaaaagacttaaaggtttctgggaccaaaaaaaaaaaaaaaaagtctttgaaaaatgagaaaggaaggatagaagaaaagattctcctttggtcaatctggccaacctttggaaataaaaagtattgtgttgcagctaataactatttgtcactgcaggcacttgctgatgtctgccctttaaaatgacccaaactcgttggcctcgaaatcagaagccaaggaaaaaatcttggacataatgttttctgtagaattaccaattttctctctctctctctctctctctctctccctccctctctctctctctctccatatctatatatatatagatgtatatatattttttctgtaggaactaccaattcctatctatagggactgattgagaagtcccttatagcagtttttctttggcttttaggatgcaatgattattggtgagaataactctttcatttcacatttgtcattggcttatttgaatgtaatcctgattcaatcgttatgatctcctttaagtaggaagagaagctggtattacattgtaggattttaattttgtactcatgaaacttttgaaaaacattactcatactcttctgactgtcaaattggcctctaagaggtccacatctcaagaggtatcaagcattggtaactattttttggtgttgttttctcatcataaaatgtacttttattaggtgactttggaaattttattgaatcaatgcatgacactgcctcattctagtaatctgatgaagcaaagctgaaaaacaaaatttgaggattgtcagtatatatacttttatttgcagtcaagagttatgctgcaaaaatggtttattgaagtaacaaaattttagctgatatattaatctgaaagatacagtatacatttttagtatggaaaagatgaggaaaaggaggttctctttcctctaggtatctagagcaaactgtaactgtccttggtatttaatttttggctaaggtactgagattagaggtggggccttagatatgattaattgtcagactgataagctagatatttcattgagtttctgttgtgctctttctttcagatcctctgttcgatgctttgttataaagatttgggcatttcaaaatcttctccatatctggtgtctttccaaacagcaggtcatagactttacacaaagaggaacgacacaggttataagtagaagtgttttaaaccctgagttcctatttcagttttgctttcttaaacatattttccttatgtgataaatgcgagtgttgaatggtgataaataccacccataggctttaaagcctaaatgttgaatttgacactgagagtttaaaggcatcatgaaaatttctccagaactaatgttcaagcaatttaggttttacaggcaactcaatagttttgaatgatgtagttattttgaaaaagtcaccataaaacgctatgtttagggaattggtactttgcatttatcagaagattgtaaatgtcaatcgattggcttgctatttggaatataattttttaaattatagttcaaatcattaggatttaattcatgattttgtactacaaactaaatctatgaaaaatatcagatatttattttaaattagaggcatgtaaaggaaaatataaattttgaaatgccattttactggatttttctcttcagcccaccctaggcatttgttacataaaatatttctgaggaagtcttccactgattttgtaaacaaacatgttttattgaacagttctttgttgactagattaacattgaccattgtatgcaatgcattctcaaaatcttagaagctggttttctttttaatcatataattttacttgttttacagtgaaattaatgcatgtaaaaagtatacctatatagaaagttaaaagaatattgctaactagttactatacttccaaattgcctattttctgtgtcttgcattggacagtagtgattacctctaaaagaaaatggatggtctttgtttcattgaagggatggataatggacataactggcattcttgagcaatgcaattgcaaatacatgtctttgcatttatggtccaatcatcttcttactatgatagcatataattgaaggttcaaataaatgcctcgtcccttcctgtggcatattaaagagaaagaaaaattagaaatactttcaaagctacctcacatactaatggtagagttgtttgagtatttaggtgatttaacaaagctgatgtattttattatgcttgatcattgaggaaaatttatttatcggaatgcttttgagagcatatatattgtcagagataaacacagctggatattaaagaggtaaaaacagattttattcaatacctcgtgaaattaggggagagctgagatccattctaatttgtgcagaggcgacttggttgttttaaggcaagaaggagggagaaggagtgggggttcattcgagttagagaagtaaaaaagtacaaagggctggacagtgtaaatgtgattaggccagctgtgttagctggaagttattgaagttaggattctatcttcccacagagaacaggagacagaggacttatccttcttgatgatgtcatttgaaaagaatggctttcaggtccttgagtgagagacacttctgatttccaagagctacatgttcacaattgtaagcccttttgagtaaatgttctaagaaacggaggtaagagtcctatcaacagatgtgtgttggctagaacaaacattaaattttcctggcagcactgagctttctcaagcaggcacttaagggaaggctagggtcatcctagggacatggccttctggggctagaaaccatactagagtttagtcaagtcttagtgcaagggtttggacagagttgttaagtgctgagagttctgtatttctcactgtcacaaaggaagatcagaagctcctgatacttttttcatcagtacaattgaatatataaatcctatacacaaaaataaactaagcttatacaagcatattggtcaaggaatgttgctggccttattaattagatagcccagttaaaagaagaattttttaatataattaatgttaaagtaggatgatagtatataaaacgtgtctactgtcctgaatacaaactaaactgtttggtttagcatttacctcaagatctcttaatatcccccaaagggtccctaaaaccacaacttatctttgtgctcatgaagtagagaagagacagttaatagacatttctagctgatagactgttgtagagcagagaacgctctgtgtttttgaaaattaaacatatgaatttgcccctcttcccctattaaggaagaagagtttcttaattgtgcgaacacatcaagtgaactattcaattagatttttgtgacccagggtataaacatctggttaaggttacatatttcaaaggaacaaaacactagaaactcttggttttaaatctcatggctggaggataatttgcagcagagatttatctggcaagcatacagaattgctgagactgttctaaagatgtaagtgtgggtgtttgtgtcgtgaaaatagctgtttacatctattaagtggataccgatggttgaaagtgccgtctatgtcaagtttttaccaaatcaacttttgcctcactgtgtcagaccattttacctaatcaacttggactgctaatgtcctttcccctggcaccactatctgtctcttttgcaaagcacagaaacggcatgcatgattgtagtttataaaacacatgtaccaatgtggtctacagcttctgttgagttcgagagggtcagtttctgtaatctcttctggcacagagtcaagaacagcttcactttcctcctgctacctctctacccgtaagtgtgaacccatcactttgctaacactcaggaaggggattacacaaaatagagcaggagccctctgacctgaatatgcatctgagccctagccatagagcttctgattcagtagatctgggatggggcctaaatatttgcatttttaagtgtataagtgatgctgatgctgctggttccaggaccacattttaagaaatatcgataaaggtggagaattaaactgcagctcagaagacctgagttcttgccccagcttgacttttacaatctagcaaatggataaaactcgcaggacttcagttctcttcatctacacagtgagtggttagattggctttgtaatttaaaattaaacagggtttgattctgattcactacacaaggttccaaagaaggaatgatatctcctttcatttcttcactttgtcttctgtccctaggtaatcttatctatgttcctgatttaacctaactaatgtttctgcaaagcttctaatatttacatctccagccctgaaactctcatttgaatgctagtcttatatacatacccccctgcctaattgacatctccacttaaatgtatcagaggcaactcagactcaacaaggaccaaactgaatgttcgaccttgtccttcaaacccgatacacatccaggttcctccatcccagtgaatgacactatccagttaagcaagccaaaagtctggattttttttcctcactcttcctcactgtccgtcaactaccattattaaatctgtcacctggtcctactgatttaaccttctcaatatctctacagtttttctttatgcccattagtatcctagtgcaagctaccatcgtctctcattggaattaacacagtaacccccctacccaccagactgttctgcctacagatagtgtgatatttaataaatataaatctagccttggctagatttctccttcaaaaggttcacattaattttagccttaaaatggtgtgcaaagctttgcatagtctgtcctttgctatgttggcagtattttttactatccctctcatctgctcattctctgtactccaactacactaactttgtttttttttttttttagatttctctaactacagtgctgtaatctctttttcctttgcacgtactattccgtttgtcagggaatctgctcactgtctccacccactccacacactcacgttttcctgcccgtcttaccggtcttgatcggttgtcacttgctcaggaaggtttccctggtcaccccctccacaaattgaattaagtcctcttgctgcatgctgtcctagtgctctttattttcctctcctcatccttaattcagtttgtaattacatgttatttgtgtgaggatttgattattatctgtgtcacccactagatattgggcattctttacttactcaccactgaattcatagaaccacagtaattgtacacaacaaatattcaagagaaatttattgaattgatgaatgaaaagttgtaccttaacatgttcctgacatgtatccaaaaaagagctcccctttggggtctattaggactttggacctaggtaaacgtaaccctagtttcgctcaggtttaaacagtagaaagtaattgggtctcttttgcatgtggctttcctaagggctaaccctgtcttcggaatgagtcaatacagcagagctgttgaaagcagactctagcttcggacaacgttggtccgaatcatggttccgtcatttcttagctgtgtgatttagaataaattaatgttttaaagctttgatttcctcttccttaatctggagatgctaataaagccaacttcgtagaggtattgcgatgagtaaataagcataatttgctgtaaacaccttgcagattgcctgttgtatgctaactaatcaataaattgaagctcttaacatcattatattagatatttccagcattgagtatactatcaggcatgtggtagaagctcaatataaagttttgttaaattgaatagattccatatatggtatttctacagcattatgctccttatttaagtgtctctaagtattttttaagtatcacctcacaaaagacagatgtttaattcattacacatgtgaattgttttagatagaaaataaaataaaaaattcaaacattgaaatcaatagtgtaccttaccttaggattacaccataaaatttctaccaatcgagaataaagtgtacagtctatttcctttctaatacttttaacgcaacaaatgtttattgaacacttactacttctaatctatgacagacataaagatgaataaagcatgccacaatgtttaaaggagctcactatatcataagaaagcggattcacacagacaactctataagataaagtggtaaatttaggctggcctgtgaaacaaaggattataggtatagttaagaggtggaatttattttacttcgaggatttcagttacctttatattctttgtctaacctttcatgtttctctttcttcagaaacagagcacctttttcctgacacattcatttccccctatggagtagagcagttgttttcaaagtgtgggtcccagatcagcatcacggggatggttagaaatgcccattcttgagcctcacaacagacctactgaaacagaaattcttggagagtggagcccgcagatctgtgatcaagccctgtaggcaattctaacgcacactcaagttaaagaaccacgggaagaaaggtccatcctgtaacaagacagatttttttcattagcatcaattttgatcatttatatatatatatatatatatatatatatatatatatatatgcatgctcacaaaaccattcaccttactaggttttagtattccccttcctgtattcatgtggtatgtatgtatacaagatgaacacacatttacctgagacaaggtaagactacacatgtctcatttggggaccagaggctgtaatcttactcaaggtcaaagcgtcttcactgctttctttcactgcttttcaaaagtaaaatttccatgtaggtgtcatttgttttctttttgtgttttagaaaaccgattaaggggtgaagtctggctaaacttagtgtcaggacatttacttagataaaattattttaatttatcttgtaatgttcaatgtgagaagaaaagtccttatgagtagtgtattccttaaataacaacaatttaaaaactaccactgaagtctgtcagagtagttttgcctcatttgtctagataagagaaaaaaggttcacattagggattgcaatttgtctgccaaagtgcagtttatttattcagaaacatttagagaggaatgtgtcagttctgttgcaggcactgtgctgtgacggggagctcaagatgatctcaaaaaatttcacagatggggtgggcagggggcacagagagatgtatttagtggttcagatactatttagactgtggccagcatttctctaaatgcaatccagataacaccttacagaatcatctgggcagcttgataaaagctgtagactcctacccttcatcccaaacctattgaatcagtgtctgtgtgtgaagacctagattgtgactggtaattataccaaagtcttagaagcaactctaggccagtaatactcacatcagaatcagctggagggtttgctataccacagattgctaggttagccttcagagttgctggtccagtaactttggtgcaggtccagattttgcatttccagcaagttaccaggtgatactgatgctgctggccttgatcgtgctttgaaaaccactgctttagctacgctataggaaaaaccatataaggcttttatactggccaatgacttcacaggcctgaattttagaaagcccccttctgcagcttggcctatagattcgaaggaaacagaactaacacaagaaagctagttaggagctagttaaaaatcatcctgacttgccaaggaaaggtgctgaagacctgggtcacagagcaaatgcaaaacactaggactttgtccctagttcaccattaaatcaacttattttctcttaccccctcatattcacgtttactccttactttgtagtggttggacaaaaatcaaataaatctgagaattctaaaatgcacacccttgtttattttctaactcaaatatgccactgttgtctgtgctctgtcaagatttcaacacatctttttctcctgtttgcttttccttttggcatatagtgagtgtgtgtatacacacacacacacacacattttttttgactccttccaatgcccttctgctctccgcagatacacttctgcattctgaataaaaccgaatacatatatatatatatatatatatatatatatatatatatatatatgcacacatattttgaaaaccttatttgaaaagaaagctttcggaggaaacgttatttagccacttaatcgagtcttttactgagggactttttgtcgtcccctaacttcctgtcagcagtccacaggcagcaggaataatgtgggagaagatcaacaggcttatttcaggaggtcaggggccagtgccaccacctgcaggtggagacatcagaagcaggaagcagcccaccagctgcagggagaactccccacagagcctaaccaagatgaagggacttgtaaatttcaaccctcccttttggcttttgtgctaaaaatgtgaatattgaggtctgccctgattaagaactagatacattcctctttgtgactgccacacttccttagcgtattcattttttgtctttcgatctcaagttattattttcaaatgcattgcacgtatctaccatggataccattgcaattggaaggagcaaacgttttgtatgtttacttgacaaagagaagtgactgcccaagccacacagagttctgcacaaatcagtaacttctaacgaacgtttgcacttccgggcttgttctctacctatttcagtcgatgcatttgtattatttacttcaaactccaatactaataatgcctcaatcaggttgcaattgggatttgagcagccagaatttcagaaatttggtttggtccatatctgtgacaggtcagtaaatcagagaagcaagggtttggttgctattataatacattgcttacctatcaatttagttatcagccaaggtggttgttatcatccaaagtggctcattaaccaccttggagactcagtatacaattgcaagtaaccctggaagttgtaaataatcccaactgaatttgtatgagtttggtaaggttaagtggaaaccagctgcttagggccttgattataaatgaagttaggagtggaagaagtaacaaaaccccaggcaaattcattaaacattttttcccttcaactttatgctcacgaatgtgttgagactcttctgaatccataaaacacctttcagcatcatctgggcagcttgataaaggctgtagactgcctgcccttcatcccaaacctactgaatcagtgtctgtgtgtgaagacctagattctgactggtagttataccaaagtcttagaagcaactctaggccagtagtactcacgtcagaatcagctggagggtttgctataccacagattgctaggctagccttcaaagttgctggtccagtaactttggtgcaggtccagaatttgcatttctagcaagttaccaggtgatgctgatgctgctggccttgatcatgctgtgaaaaccactgctttagctaggctataagaaaccatataacatggacaaggcaaatgaaaaggttggaattcttctgaatcccaacacatttgtgagcataaagtcgaagggaaaatgattcttctgaatccagacacatttgtttaaggataaactgttttttccttctgaaaatttaatgtctgattctcgttcattcattcatcaaaagttatcaactatcaactataggtaggaactgtgcaatatgctggtgataaagagatgaaagacacagcccctcccttcaaccagctcctagttgaggtggcaagtcagctgtataatcaagtaattgcaagactgtgcactgaaaagggtgaccacagggtgtgatggccacccagggctgtggaatcagtcccaaaatgaagaatgaaagcagggaagggtaattcagaaagaagaaacagttcgcataaagacccatagataaacatcaatcagatgtggttaagacaaaagtaagtttctggaggctgaggaccttctcagctatatgtttgcagtgcttggtatagggctttatgcatctacatggaagacagaaagggccacatcacagtggacaaggcaaatgagaaggaggcagtatcagaagatgagggtacaccggagatcctagttatatatgggcattgtgttcatctcaggagttactgagtaatgggaccttgactcaaatgaatctcaagtctgtttttgcctaatcttggttttaggactaggattagcatacaaccgcactaggagcctagttatacgaaaggctgcattgcggacctgatacagttcaatatacatactgtcaccttgcaaatagggttacgttagttctcaagactgccaatcctctgtgctctaatccttttggcttttttttttttttttttaactgtctcactctgtcatccaggtgaagtgccctgggatgatctaagctcactgaaacctccgcgtcccaggttcaggtgattctcatgccacagcctcccaagtagctgggattacaggtgctctggcgccaccaggccctgctaagttttgcatttttagtagagacagggtttcaccatgttgcccagactgatctcaaacgcctgacctcaagtgatctgcccgctttcctttggcttttaacactatagagcaagggtccccagccctggggccacagaccagtacaggtcagtgacctgttaggaaccggggccccacatcaggaggtgagctgcagggccgccagcattaccacttgagctccaccttctatcagctcagcagcggtattagattctcataggatcacgaaccctattgtgaactgtccacacgagggatctaggttgtgtgctccttatgagaatctaatgcctgaagatctgaggtgcaacagttttatccccaaaccatcgcctcccacgcacctctccccacaaccccacccgcccctgatccatggaaaaattgtcttcctctaaaccagtctctggtgccgaaaaggttggggattgctgctatagggcgatggttttcacatttgatcctgcatcaaaatttccaggtgactcattaaaatactgattgctgtgccccactcgtaggagttctgataaggtagctgtggggtgagacctgagaatttacttttctaataagttcccaggtcatgctgatattgctttgataaccaaagcaatatcagctttggttatcaatatataaccaaagccacatagagggggagaagttccttgggtttagcccagtgtttactgcgaccaccaaaattgctggagcttaaccatggctcagagagttatgttctgttcactctgtaggctgctattccctgtcaccttttgaactatgatggaggggaagagctgccagctcaggagatttcacttttttctctgcataattgaaaatccagaaacacagggttttgggaaagctatagaacagatcatcagtgatcagtgtttaataaagtaaagcaataaactttactgtgtaaaataggatactttattatataaattttgtccccttcccccacctcacaggccaataaaataatatacttcttgtccctgggtgtaatgttattggaaacctttgaatgtaggagaggcatgggcttgtaagttgcagaaaactgctagcctaggattgagaatttcatggataatccaaaaatagatgattttacagttataagccttacgtgaacttgaggtaagaaaacacaatgcctttatagtcttctcagttgctccacatgccctctgagattctgttctgcccagcctctctggttgtcacatctctgggcattaacagaaagttcacatactctttgtctctgatgataatccttctaggtccatatagaagatccctatccaaaccatcccccaaacaaacctattggttaaatattttctccaccgaaggcactttcttagattctaagtgccctgtaggcaggcttcctctctgatttgggagagtacaaattgcgacaaggttaaatcatagcctgggaatttgacctaaaattcactcttctcccatatgcattcatgaaccttctgctggtttttaaaagaagctacttaatgtcagctcgaagaggttggaaggggttaaaaacatgagcatggcagtaagaagatttatgaaggatctgagaagattatgacttgatcagatggtattttgtcagctagccacatttgtgaagacttgaaaactagggaggcttgtccttctaagagggggcactgctgggacctggattctgtggaaccgtattagtagaataaacaataacctttgcttgtatcaaatgaacttctattctcatgtgtcttttgacatatttttattaatcatatcactgggacctccttgctgaaagatatctccgttccccattctgatgactcccaactaggagtgagatcaaatgaagatggcatggaccatttctccatgtgacagctctctgtggttgccttttaacacttctaatgccctttctcttaagaattcccatttgtcgtctggcactggtgctgtgatcaataaaaatgtaatggagtgaggcttagaaacatgaggaaatttactcaagctatccatttattgatgtgtccatttgtgttgtcagggaagaaaaactttttcactcccctcttaggttcattacttggggggctgcaaattaaactgacgacagatagattggcaatagaaaagacaaagtttattcagagaagtatgtgggagctcacagaaaacatagctcaatgaagttagaatttggggcttatgtactattttaacaagggttttgaaaagaagagtgttagaatttcaagccacaaagttggtgggaaatatgaaagaaactaatgaaaggtaatgtttgttttagtaaagtctgtttatgtaattttcttttcccagcgacaacttctcatctctggtgacaggagtcactctttacccctggtgcaagaaactttccttaaaggaggatttaaaacagttgaattatttcagaaatctttgcttttaggcagatagggggagtacagaaaaagccccttcccgtatctgttgatcctcaaatggctttagctcaaaacaatttttacatcacgatggcataatgtagatctcttcaatgtgttcatttattccacagatatttgtgaagtacatgatatatgccaggtacttgggatacaagaatacataagtatgtccctagtctcgtagaacttacactctagtagtgagctagagaataaatgatattatttattatatgcatacacatatgatttcagatagtgatccatattggaaataaagctggttaagggaatagaaaatgatattgaaggtggacttgtttagattgggtggattggcatggcttctctagggggcagtatttgagcagatatgagagcagatattctccaatttgggcaaaaacattccaggcagaggaaacaagggcaagggcactgagttcaaaagagacttgacctagccaacaaatagcaaggattccagtgtaagagaaggtggggaaggaaggaggtgcaagtataggcaagggcaagatcacacgggatcttgcaggccgtgataaaagaatttaactctttcataattttgacaggacatcattgaagaatttagaaaaatagagtggagatacctgatctgctttcttcaaagagttcattcatcattgctgagtagaggttagactgaaatggaagcaatagtgaatacagggagatagcacaggaagccacgttactagtccacatcagaggtggttcagactagggtggagtggtggggtcagttagagagctggtatttaggatacattttaaagacaaagctgacaggatttgctgtgatgaattagatgtaaagtatgagaataattgagaattatttctaagttctttgctggggaaaagtggaggaggaaaaagttagggtacaaggtgtgatgaaatcaagagtctctcttattatcagagtctcattagatatccaagtggaaatgctggaaagaaagttgggtagatcagtctgaagctgaagacagatactgtgactggaataataacgtaagagttggccggacacagtggctcactcctataatcccagcactttgggaggccaggataggagaattacttgagcccaggagtccaagaccagcctgggtaacacagcgagacctcgcctctacacacacacacgcgcgcaaaaattaatcgggtgtggtggcacatgcctgtagtcccagatactcaggaggccgaggctgaaggatcacttgagcctgggaagtcaaggctgcagtgagccgtgatcacaccgctgcactccagcctgggcaacagagtgagaccctgtctcaaaataaataaataaataatgtggcagtcataggcccttagatggtttttaaagacatgggactggatgaagtcttctaggaggagagtttgggaaaagagcccgagaattgactgcacctttcaaaacaggaggaagaaaaaaaatactcaaaggagacaaaagcaacttctgtgatttatagagaaaaccaggcaagtgggatgaagaaagtccttcatgatagaatcaaaaacagtgtcaaatgttgaaaatacaattagacaaacacaaaagaatagaccattgggttttgcaatatggagctcatacttgaccttgataaaagacattttcactggaagcatgcatcaaaaaactatttgtggtaggttaaaatgtagtaggaggtgaggatatacagacagtggctttcactgtgcagatactgctgctcatgcactaattaaaagacatttgttgagtatctactatgttgtatccattgctaaatagtaacagctgggtttagtcaggtagaacagcatcaaaatcattatagtatcccaagataggtacagtaaaatctgtgaaggaatcagagtagtctcttctccaacagagcgtaagacccagcttcacggagaaggtggtagattagctcatctgggaggctgagtagaagcttgtcattatagagggagaacatcagaagtgtggacaacagcttgaataaccttgaaaggacaaaagaggacggtctgccctggaaatattaagaagtctcacatgattagacacaagatattaggggaaaggcataaggtgaattgagtcaatgaggtcaaagagaagctagctggaggaacaggcgatcataaaatgagtaaaagtatatattcaaagattctttttagaagggctacacaggatggataaggggagagagagagttgaggcacagagacaaattggaaaggtgcaatcataaccagagacatgaaaaacccatagaaatctgatgtagattatgtggtccccaaggttgaacaattaagtacgctttcagttgttatgcccatgatattaacatattttataactgcaataagtgctgaagctaaagataaatacaaacaatgtaattcttattctgtgagaaaatgttgtagctggaagttaaacatgtttcttagctaaagaaaaatattgtgtgatctggattacttaatgttataatttagcaacaaaatgttgacattgagccttgcataatcaaaaaagtagtctattcaataaccacattctcagaaaaaaaacaagaaaatattagaaacaatgataaattatcgtagtaatttaattcagtattctattgttttatttggatttaggaaaggcagaaatgttgaaatattaatatatatccctgtaataatataatttgtgtctgagaggtaggaatgagggcatgaggtcaaagtttgataatgaacttcaaagctataactatgatcaggaaattaaaattggacaataaattcctagaatcgtcaggagttgcttgtgaaatcgagaaaggaaaggatatacacaaaaataaagaacagccaatgctctcaaaggagtctaacttttataatagtcttctgtgttagagctgaactcttctggtttagaaggacactctgttgcctggaaatagggcatggaaaaagtcatcagagtcatgtcatctttcattcttcccatgaacgaaatcgaggccctgaaaagtcacctgtgtttgctgtattttattgcaactaagatgtgcatttttaaattgatacataataattgtacatatttgtgggatacatgtgatattttgatgcatgcataccatgtgtaattatcaaataaggatatttctgtatccgtcacctcaaacatttaccattgctttgtgttgggaacatttcacgtattttattatagctattttgaaatacaaaatagattgtcattaactatagtcaccctactggatgcaccttgtttttaatatttctgaaaacagatacgtctcataggtgatggtgtcacagctgtgcattagttattattgcctgtgcaggtgcaaacgtaactattcatattgttgtcaattaattaaatagttacatttatttatatgcgtttattatactaataaacacaatattgagatagttgagctctagttttgactctgctgttaactagctgcgttactttaatttacttaactaatttggctttcaaattcctgataagtaaaattacaacatgagtttctcctgctataatagcctgagaaatcggtgaaacacatgaattcagatgttgatgctatttaatagcgggattccagatatctacttgccattatgggagggagagaggaggtggactggaggctgtgatttccctaggaggttgttaaaattggccaggtgaggaaagctgagacagaccataaatatgaagcatgatacctagccctcagtgttgaaagaaaatcaaatctcatctttgtggtctaaatatcagtatgatacaatcctctgtgtagacatatcctctgccctattgttttctttctaaaagctaaagcccaggtgtgatcacatccctccgttatttacaaatttctgatgatgatgattcttctaatatctacattccttaccattaccatgatgtccaaaacctattataatctattcgtctccaagtgccatgttgtggtcaccctatgcaccctctaaacccaccatatgaccttcccgctgctacttgaatacagttggccctctacctcgttgtgtctttgcattgcctatttaattgcctttccattctctaaatcactctttcgctggaccagcaacatcagcaccatctgggaattcattagaaatatagatcctcaggcctcatctcagacctgcttgatcagaaacattggagagtggagatgagcagcctgtatttttatcagccctctaggtaatttgatgcacactaaagtttgagaaccactggtctagagcattcttctttaactctcttctaaaaattattagaatgaattcgagggacgggatctccttgaaagccaagaacatttctttgtcatctttctgacttcagggcgtagtacactttttggcccataattaaagctcgataaatgcattctatgccaataaatcagctaatcaaatatattattcatgcccttgaggtatctgaaatttgtttgcagaatgtaatatataactatagagtaacaagagaataatttattgccatagataataaaacaatatcctctgtataataaatcctagcctctgctcaatgggcaaaaacgggactggggtttcagattttaaaaagattattggtaattaaatcacctggagaagcacttgctgcagagatgggacttgaagcatcataataaactgttgtttattatgattcggtcagagctgatggaatcacagggattgtgtgaggtatggaaagtggttgacattgaattccaggctgcacagttgggacttgatatgataaccaaaaagaaagaatgtctggggtggtagcaagctctaaatttagacaatctaggcttatcctaaggagaatatagatacagataactgaagtttgattaaagggaacctggtgtatcacaaatagtaaaaagctgtagttagtctatgcagctatcagctagccacataatacttttgggcaaatacattataaaccaaaagaatgacatggcttatctctgtaacaaagtggctcattgttctttattctactgttatccttaagaaaaaaattttagtaaatttgttatgctatactcaacttcaagaagggatagcgcttataaaaaaattgtttaaagaaacaggcctatttctctttgggagaagccacggagaaacgaaaagaatggaacgtgtgtttctgcccagatggcaataaaatgtagggtaaatttctgtcttttaaaactgtattttttccatccctctgtatatacacatatcctaggactgttataaaatgctgcatgcgtatgtgaaaatggaaccttattgggctgtttgatggacctttaaaatatatttgttggtttggggtacatactagctatgcaatataatccgcattatttcttatgtaaacaatggataaactgtttcacagtccagacatttatttggtcactgtttgtagaatgtctattttatttacttctgaatttgtattccagagatctgccttcaatgttggatacttccactgtaatattctaggagatgctcactttctttttcagcatctgacacagtaccatctgcctcctcttttcttgccacaagtaataacaattttataaaggaggatcacattacagaattataggtggtaaactttctaccaccagatttacccaagaacctgaaacacattttttcaaaaggaaatagaatgtccttcttgtgactacatcggaattttgcttgcagcattatgctttttttttccccctagtgtagctagccatgtggaactgaagccattagccagctcctcatcctataaatgctattacctgggaaaagaggcagaaaatatactctcttctccagttagagtctaaaggaagagaacaatatgggtagttgtgtttaccacaaattgatagaactcctttattttaaatgctaaaaccaaataacttgtttatatgacttcaacattgactatcacacactgttgcatgataacagagtgaaaactacctctattggatttaagtggggaatctatgtctcattctcattctttttttactgtggaaactagttgattccaggatcagccttagctccaacttgccacactttgagttttggtttttcacttgcattgtcacaggaaacttctataggataaatcgaggaagattttactctgcaacgtgttgcagaattaaacatttaaagtggcaaaaccttcgtgtgtaggttgtctccccagagaatgtaaaaatgaattgaaggcagcacctaataggtaaacgacagccaatcaaacaagaacaaatgaaatttgactggcaaaatcaaattgaaaatgtataacgctgaatctcagaatataggaggatgcatagaaactaagctgtactattataaaagtcatagccattgaaaaataatgactggttaatttggttttctttacctcatggatgtgaatggttagattttgatgttggtgttatttgacgtgtgtttgtcaagaagttgccttagtcggctcgcatttaggataaaaaaaatattttaagaaatgtttaagagattatgttggagacattagaaacaaaataattatgcagagggcaggactatcaaaatataatagaaaaattacaccgctcttttatgatttcctcctttttggcatttaacacaaaactttatgattacacacaccacgcactccagaaatgcttaaaggaagatgagaggaaaattcaatagaagtagcaggcatttctgtgaggacagcagaatgatcacttcatctctgtattttttttttttcaaatttctgtatctgtacaatgtcttttccagctctaatattctgtgatttggtaatttccgcactcagattttctttaatgaattttgtatgatattacctatttttataccagatattacctggctctaatttctttttcaccctaggaaataaaagtatcgggtgaatttcccattttcttatgttattgatacaggtctctgttggatatccccacgattaactttcctgcagcatgttcgatggtggcttaaagaagaaaccatgtatcagagccccttgtctatatagacttttagataaagagaaatacatatcacagaattattctgggcgcatagagtctctaaatgcaaaaaaaaaattgtattgtagctgttgattcttctcagatagattgagtgtagagagagagcattccaaaaactgagcagaagaaacacagtctgaatcaaataacatgaaattttagctaacaagtaaataacacttttttcagaatatgcaaataatattggtttattatgaaaaatgtataggctgatagatgagcatagagaaaaaattataaatatcttctttaatatcactttccccagcaaaccacttttaacattttgatacattttcatgttcaaacatttcctaatagtcttttttcctgttatataaatatgaattttaaacattcgtatgtttatgaaaaggcaataagatactgctcttttataacaggctttctgaacttcacaacatgcagtgtattctaacatgctccttgtgttcttaactaataaaaaacctcacgttatttaaaaaaccatcttaaacataattatccattaagagaagaggttggggtagagagtttcagactatcaatatcaaagttatattttctgtaagtattttaatttttaagtgtagctataggtatatgattataaaaccaatagcagagaaaagataccacctttgaatatagttttccttggttccatgaaaatggcctcctttctttttgccagtccctcagtatcattaactcatttttctgtaaatgccatcattgtatcacatgtcctcaggaaaaggcacttttctcttttaagctagtgtttgttcttgttctaattttatggcaatttaacgagtaacaatcctgtttctataaatactgtttcctaattaatctattgcattctatccatgagaatttagatgactttctttgtaagagaaatctctgtagcatgagattcttctttgctcttaaatttcattctttcacatttttaaatgacctgatagtattttgttgtatttgtgctgattttttttaaccaatcttaccttgttgaacatgtaagttgtttctaatatttgcaatgatcaaaatgtggatccaacttcactaaagcgttaagaatctaaaacaaaacaaagaacaaaaagttggctgtcatcttgcttggaccaccccgtgagttactattttcttgtttccggtcacagttcatcctaaatcatttcagtacacaaaatgttttttaaagtttgggacagggggtagagaatgtcaattattcctccaaggcagtcatatgagcattgagtatcatgtggaatagttgttacttgtaaagttatggggcatcaaacccagtcaatatgtttctggaattgaaaaagtccctggacattctaatgatactgttgttcactttgcacctactgttaccactactttgatctgtcaacactgcccgtaatggttaattttgtgcatcaacttgactgggctacaaggtgcccagatatttggtcaaacattattctgggtgattctgtgcaagtgttatcagatgagattaacatttaaattggtagactgagtaaagtagattgcccttcctaatgtgagcagacttcatgtaattaattaaaggcctgaatagaagaaaaacactgaccctcccctgagcaaaagggaatcgttctgcccgactgccttcaaactgggacatgggctttttcctgccttcagactttaaccacaatattagctgttcttgtatctcaagtctgctctacttcgattggaactacactatcagctctctcgggtctccagcttgcttgttcaccctgtataccttgggagttgtcagtctccatagttgcctccataattgcatgagccaatttcttaccacatacaaacacacacagagacacacacacacacacacacacacacacacacacatataattatatatgtgtgtgtatacatattctcttattccttttgtttctctaaggaaccctaatatactccttattactctttctactgccttagagatcttcaaggccaagagcgtaatcctccatcctggctctttttcctaatcattaatgatcaactcatagccatttagctcaactaaaaataatttgttcatgaagctttacactcccacatactgaggaacgtggtacctaagatcaaacagtcactgcctcatcaaatgcattcctcttcaaccccatacaaatgtccccagatggaactcacaccataaaaatattagatcccattgacttttctgctttctcaaggatcattgcagagcttgaaaaagatggctcctccctttgcctaagcaggttaacttggtgtaaaagtacatgtaagatttggcacaaaggaaaataaatcagttttgcctgggtcctaagaaacatttccctctgcctcatggtaattgtacctgccagttgattgcattactcaagtggagaccatgaagtgaagtggtagaacaagaagaaatccctataattttattaagtatggtgaaaaatacagatatgtagagaaatgactgggattagatggagcaaaacataattcgagatcctgatacaaattgtacttcctggctcaagggagggagcagaacattccctgctacatgggaataataataaatgcctgataaaaatgcagatatatcatagactacagaagctgaagtggattcttatggtcccctactcagacagcctctccttcagatgaagaaactgaagcacagaaagctcatcctagtgtttcatattgaaaaacccattcaagtctattttaataacctgttaccaaaaatgagggaaataatttaactttaatgtttcactttgcattacccttttcctgactagacttctatccttttcttgagttgagctcattaactactatgaaattatggttatgggtagaggttaattttatacctgtccatcttctggcatcttatttacactaaaaatcatttttaaatggcttcattttaaaaaatattatttcagttgacattttaaaagacacatcatttatgtactacagaatatgcattttatactctcctttattaattttattattttccaggtagaccaatcaaatgaatcagaaattcttggttagatctattagacagcataagtatgtttttcatcattaaattaagatgaaaacacaattttactttaaagtgtttgacgtttccagcctttataaagtcaacacttaatcacatctgaaatttgcaggaaaaaattttgaaagccttcaattattaacattatttcgggagaaaaagccactttgccgcagaactttcacttttctctcgtgaattaagtctgatacaaattattcattatggtgaagtttaaacataatagagtctagctacttccacaaaaatactattcaatgagtttctacattgacatctaactgaccttgtaattaatgttgtacacgatccttttattatatgctggattatcaaatatgacttattagcagtataaagacacaaagttctgaaatgtaatttatagccatgaaaaggaactgagctttgtgtgacagttaaatttgaagagatcaggtgattattatgaagcatgaataataatgcatattaaactcacgtttttgtttaaatcattaatatgattgttttagaagaaagtctacctctatcatatgggcaataaaatgtgtataagagcaaacatttgtgtatgtgaaataactcaaattaaaaccagttttccacattaattcttacagtttttaaaatttaaatcatttaatgtatcacacatagctttattcattttaagctataaatgttacaatttctgtttaagctgttaatataagctttgtaagagcaattctgtataaatatagaattgtcattattcactaatagctaccatttatttagtgcttgttgagtgcaaaagtactgcactgagatctttgcatatgttctcttaatgttacaattcttacctgaggcatttctgtttctgctggaatatggtctctctgaattgaacaagggaggcatttttggttgttatgatgaaaggtggacactgctggcactaacgtgtgttggtaagcgactagactcttcatgatgcgtaaacagtgtttcctcatacccctgcacattcaaatagaggaaaaccttgtttatagttaatttcccctagaatgtaaatccatttaacatataaacacaaagcgtgttttgtgtggatgttttttactggagcagggagacaggagaggaaatgcagttttgatagttgctgaatttttcaagaatgcagcaattatagaacaatttctagaagtttcctaggagctcttttccatagcagaaaactaggacttaatagccttgcgactcatggtacttgagtgttccatacaactcacctatattcaggggacatttgaaaaattctacattaaaggggattcttaacataggcgcaagtgtctggcatcttcaataggtcttctggtgtggccatgaaaacattcacacgtttcaaagtattttaaaataaaataaaacatatattgttgtgttatgaattattttctttcttttttatatgatggttagatcactgtgcagacaagtttatgagatctattcatttcatttcagggtggtaaatgagggtgttactaaatgttggttctaaaaagggagacattgggtattacagaattcagaacagctctaagccctgtgcacatttagcattagaggacacaggcaaatctggcctccagtcctggcagcttcttcactatgtatatgatgttgggtgggttgctttacctctctagtttttacttttatttctaagctagggctattcatagttctttatcatgtggttactgtgaagtagcaaagcacctgacataattagagcagataaaatgctcaacaaatattgcttatcagaaggattatgtattacctcccgaaatacatcaaaaatatattttccaattcaaagaatatgtagtacaaaaatcatgcctaaattaacagagttgcagtagcccaaggagagaagataatcattattgatttcttcttcctttttgctaagcagttctctgtctctgcctcctcagttgttgtccatcccactcccccactcccaagccctgaactctgaggggtttgctgccgtggccggttctgtagtcattgctgtccaatgatgaaaacacaaaatactgcaacagaacactatgcctgtcagcttagctcccttctttctgctaaatgacactcaatcctattcttttgttctaaaggatatcctaaatgaatagccactggggggaaaaaaggttatataagattgtgcactgtgtgaaactgatgcaaccagatcaatgatgtgaatttctcttaactatttactgggatctagaaacaggtctctcaacttagcagtgtttacgaatataataggccttccttatacatacatctgaagccaatctgagtcaggaagagtcgtggtctgataaatattttgaaaacttgcatttgttctattaaagcaaactgtttattaatagtgtgccttattttttaaagcaaaacatttataaacagtagtcattacaggcacttcagtgtacggagtgatcaattgttagacctttaggaatcgattgtttcgtggagcttcggcttataattgaaatgtcatcagaaggagtgtaagacatagcttcaggagaggccatttatgcgcttttgttttcagctaagttatagagtcatcatgtgaagaaagattcttctcttagtaaaaatcctttaatggttggaataacacttgatatttaatatttctttctactttatatccacatttattcaagtgctaacgcgtgtggggcagcaatgaagcactttattccaacattatagttctcatatctgcgtatgattatttttcatttatcgttagcatatatataatgatgacttttaaagtacactgtattatattcactggaataatgattagctattaataatttgaacactatccaggaaattactgaacatgtcctacaagataaacctcgtatgatattgtctccaaataacagtgctaaccaagaagagtgctaccaagttcaaaagtaatcacagggagtaacctaaatgcagctccgttgggttaaaaatagtttctctaaattatatgttccctaagtttgagatcgatttctacaaggggataaaatgtttttataaattctcagtgataagtcatgtgattaagaacccccaactttttttccaaagacatttgcatctctgatcaaaataacaagatccagtcttagttataaattggggaattttcatcaaaataaggagctactcgttgcataagaagactagtacaacttaaagccaatttaatttcaatgaatgcatgatcagctccattgccaattgagtgtttttcttattcatcagaagatgggttcatcatcgtgtttcatatcaactgttctcaaaccatattgcccatttaaataaatatagatttgtctcgaaattctaaattcatgtcatatttcataaatagcctatggtcctatttattactttaaaatattatagatataatatttttattctaaagtaactgtgttatacaaccaaattattcatttaaatatgtgactttttaaataagtaaatgacttatttaagtaaagtcattaaaattttccagtctgtccttcatccacctgatctttgaatgagttaggaacaatacaggaaactaatacaaacttaattttgattacaaaagatgaaatcattctgttatttattcaacacactatgtgtcaataaaatcttatactgtgaaagaattcgtctaagtccatttgctgttgcttgtaacagaatacctgaaaatgggtaatttacaaagaaaaggagtttacttcttacagttacggaggctgagaagtccaaggttgaggggccacatctggtcagagccttctcccatccaagtactaaccaggtcgaacctcacttagcttccaagatcagataagagtgggcgcgtttaggctggtgtggctgtagacttgttagagcctttttgctcatggggacacagcagagccctgaggcagtgcaggacattacatggcaagaaggctgagtattctaatgtgttcatgtctctcttcctgttcttataaaatcatgaatcctactcccatgataacccattaacctattaatttatgaatggatgaatccattcataagggcagagccctcatgatgcaatcacctcttaaaggcacaatctcccggtgctgccacgttggggattaagtttccaacacatgaaatttgggggacacatttaaactatagcaaaattgtaataaaatgttatatagaagcaatgttcttactgattataattgttatattggtaaagtgttaagtcctctaaccaagggatatatttcagcttattataatagttttaaatttacaattcaatatgaataacatctggtaaaagttcttttcaagaaatgggaaaattagaaatgtttagaagaaaataattcaataaatattaagttcaaactggattcatagtttatgtgaaattctgggaaccaattgcaaggggagaaaatagttacaatagcaatggtgaggatgagaataagagcaggtatcaacgttaattgagggtgtgttatagttctaatcgtgctatgcccactacatgacttttccctgtgtgaggtttccgagcttcttcgtagtaatcctaaattgagctggagagaggctagggtaacttactcacgctcatagagccatagagtagtaaaacctgtatttgaactctggcctgtctgacatcattctgtggtcttttaaaccaccactgcttctccatattaaaactccaaatctaggtgaaaagaagaaaactcagaacatgttctgcaacaaaatataacaaaatataatgtatataaacacttatacataatatcactaatatctttactatgaaaagactctgatacgaacattttacataattcatgcagaagtgttaatcacattgtctgtgatgagctgtgtatgtatctgataaaattctggcaaccagacatcaactcgtaggcatagatctgtaacactaaatatttgcctcgagaaacttaaagaaataaagacaaatgaatgaataggaacatggaactgagtacaagataaaatcctcctaaagcaatcgatgtacttgctgctgcgttattgttctaagcaaaagaagcatggcgaagggagatgtgaagctaaaaacagaatgcttagaaggagatgatagcaggagggaagcaaagatgggaccaagctcccaaaaggcgggctttgaacaaacaaaacagaaagctaagcctttgacggatgcacgggatgcaagaaactttagtcaggaaagaggaggcgaagaaaaaccctccaaagaaaaggtgaacaatattttaataggcaaattgacagatagcaagagatatataccatgctatgttttctcattgcagctgaagacaaactggggttatttatgctttgaaaaagcgtaaatctaaaaaacaattgtggaggaagaagcgatgaaaacacgtgttaatacagaaaacatggctccaaggctttaaacttccttgtgagataaatgcatttacattttccgtagtagctaatatatatatatatacatatatatatatatatctgggaaaataatacacagtgattttctttctttttttcatctacttatgtgagaaaaaagtaggctatctgaaagcttttcagttaaatgaggaagaaagttaggtgatcttgtaaataatatatatgttcaagataatgtaaggcccttgtgtagttttcaaaacttatctttaatagcagtttcttctggggatggggtagttcaaagttgaaatgttagaaagatgttaactttttttcctttttacttctccctttcaggatggaattaacaaatttgattacaaatagatctcagagagaggcaaatgcattgaatccagaagtaacataaaattagatcatgtttagttatgcccgaggtcacatggtgataaaaatgaggataaactgaaattgtctgtgagccagattagtttattttatgccagtcctaggaaaaagacacatcatggtaggatacatcctttttttttttaattatactttaagttttagggtacatgtgcacagtgtgcaagttagttacatatgtatacctgtgccatgttggagtgctgcacccattaactcttcatttaacattaggtatatctcctaatgctgtccctcccccctccccccaccccacaacagttcccagggtgtgatgttccccttcctgtgtccatgtgttctcattgttccattcccacctaagagtgagaacatgcgctgtttggttttttgtccttgcgatagtttactgagaatgatgtattccagtttcatccatgtccctacaaaggacatgaactcatcattttttctggctgcatagtattccatggtgtatatgtgccacattttcttaatccagtctatcattgttggacatttgggttggttccaagtctttgctattgtgaatagagccgcaataaacatatgtgtgcacgtgtctttatagcagcatgatttatagtcctttgggtatatacccagtaatgggatggctgggtcaaatggtatttctagttctaggcccctgaggaatcgccacactgccttccacaatgaacagacacttctcaaaagaagacatttatgcagccaaaaaacacatgaaaaaatgctcaccatcactggccatcagagacatgcaaatcaaaaccacaatgagataccatctcacaccagttagaatggcaatcattaaaaagtcaggaaacaacaggtgctggagaggatggggagaaataggaacacttttacactgttggtgggattgtaaactagtacattcttaacatcaatttattcctaaaagcaatgttcatagggcacactgtaggccatagatttgcctcacaaatttaaaggcctaagccctcaacatgcacagcagtatactcagagactatttgtaaagatgacgattctggaactttttaatgaccccaatcattagcaatgattaaaattaatattcaacattctatatttaccaaggcaataaagtagactaatctattttaaaagggttttaaaatgaagagatgaaacaaaccaaatgattttgatttaaacttcatgaaaacataagttgcattaatcaggtgattttgttttatgagcattctgattgaagtgatcatatttagccccgggagaataagagaaggtaaagtatgggtatggcactgaatttactgagatgattatattgtttgagttaaagaacttgtattaagaaacaagtatgtgccaaacattgtgctaggagcaagcaatgctaaaattacatgggtagaaagagagaatgaaatatctagaatgagttagaaacatcagtgttttccaatgtggagccctgacttcacatgaaaattctcattttcaaacaaggtagtttatgaaaactggactattagcaagacagggtgggcatgccatcagtatagtacctggtgtaaaactagaaattttaatcatttgtgctttcattttataatcagtaaaatccaaggtaggacaaacttttactttttctgtataatggactgatatttgaattatacccaactttaattttttgccagaaattatgctttattgtttctctaaaatggtactatagatctttatttatttctatatatttatatgatttttacatatatgtgcatttacatgtatatacatccataaactatatacatatatacacataaattacaaatatgtgtacctacgtacatatatatgcatatatcacgcaaatacaggcacattttcaatacccctttttgatttttttccttgaagagcatagcatctgaatttattatggatttatttttaatttatggtcatgttctttgagtgcttttggtgtttatctggttgccccaaactcgctagcattgtaaagaagatgtgcaaagcctgaatctagactgactttcatattgactttattagtcaaaaaaagtagatgaaaatgtaacagtccgtgttaaaaatgggaataagacagatgttcaagccctagcttcagcagtttttagctgagatttactggaagaaaacattttctgaactgtaaaacatgcaaaatgcctacgtgacagacttcattaacattattaaatgctatgatatagtaaaagaatttgtaaactgtcaagtgctttgtcaacattaggaatttagttattataggtatttccatatacatgttgtatttagaattccctttaattttatacttagggttgatttgtattttaactaagtcactttatatatctggtcccattatacaagtatacttttccttaggataagaaagtgatctttatatatgtttatcaacccaaatgcccatcagtgatggactggataaagaaaaggtggcacatacacaccatggaatactatgaatccataaaaaagaacgagttcatgtcctttgaagggacatggataaagctggaagccatcatcctcagcaaactaacacaggaatggaaaaacagacaccgcattttctcactcataattgggagttgagcaatgagaacacatggacaccgggaggggaacatcacacaccgaggcctgtcgcgaggtggggggcaaggggagggagagcattaggacaaatacctaatgcatgcggggcttaaaacctaaatgacgggttcataggtgcagcaaaccactatggcacatgtgtacctatgtaacaaatctgcacgttctgcacatgtttcccagaacttaaaatttaaaaaactttaaaaaaagaactgtagatactgatccaaaaaaaatgttcattaatgggggttaaatgattatttctaagtagactactcttgaacccttgaatctttaagaattttctttgctattgaagccattcaaactctattttattaaagctgtcgttattctagtagattttaaacagtaatacctgaatacattagaaatatgcaaatctgcattacatatggcatctgcagagcagaggagtttggtcatctggactcatgctaaagtctccgaaaaatccgcttgtcttaatgatggttgactcgctaatgctatgcgtatatagtcttattttaagtgattgaatgatgtggctaataacccctctgttagatgcactcagaacctcacctacctgggtcctcagctctccagtgaaatctctactttaagtttattttctaacatggtaagagccttcagtttatgttatgctcaggcccgtcactgtgaataaaatattagaaatggactttttttttttgtatttttttaatggatcccttggaactttaaaaaaattatttatttgagctttctactgttatcacagtgtctcctaagcatggcctcccgttttttgttggtaatataattcttacgttattcaaattagtaaccattatttttctcatggctagaattctggaaactattaggaaatcactgagcataattgaatggctgtttatttgaagagctatgtcaaggcagcatagagttgtattttcttgcaggggctctggagtcaaagagcctgggttcaaaccttggctccaccactttctatctgtggggcattgggcgtgttacatttgtgaaacttttgtttctccatttgtaaagtgaggtttgggggatgattaaaccagataactcatgtgaaatatttaatggaaatgtatttggtaggggatttattatttttaaatttggattgcacatgacacatgtcagggatcatgctatgcattttggatagaaagatggctaagatatcatgcctgactcttaaaaacttacctaatggtaaatgacgagttaatgggtgcagcacaccaacatggcacatgtatacgtgtgtaactaacctgcatgttgtgcacatgaaccctaaaacttaaagtataataaaaaaaaaaacttataatcaactgtagtagaaagagatctgaatggcttgccatttagctaggcacatggtatatgtgcttaattcatactagcagccactacagttgtcatgattaataatgagcttccaactgcacagaatgcttttaatccatagaaaatcaaatcagaaacaagtttttgtaaaattaatgtgaaaggagcaacaattaaaatgcaagattgacatttattttctaaattggttctattttctttcacatttacaaaatttataagaaaattctttatttctatgtgatataaagaactagaatgtactttgatgtgaattattgttgccagtgctgttcaacttttatccataatttactaagcacctacatttagacaaaggcattatccatccctttggggaggatttcagatgattcatacacagacctggtctcgaggaatttaagattttctttggggagggaaataaggactttaaccaactcaagagtacttagagaattttctgaaaataattttatcaatgaaaacttgttatattaaaagaaactgtcattctgacttccacaaatctaggcttgaaactatggataacgagatattttctattactctcactcacgtcattttcacaaagtgaaaaggtacattttaactagtgaaagaatagaggaaatggaagtagctcgaggcagtggacgatgattcaaaaagacagggccctattatttgatcaagttatgcaacgactctgggcctgtttcttcacctctggaaggaggaataatctccaagccctttcagactcttttggtaattcacctccagcacatcttctaaatgccagcattaactgtcctctgatttgtctcatgtttttctagccccatgctctcctgttcgccatttaccctcatgcaaggtacaaattacacccatcatcacaagacacttgctcaagtcccattgcccccttgaagacctgccacacctactctctcaaaaaccatcatttcctgaaagtcctatacagctcatttggtatttacagtgtactgccacaagccactaagcatcgttttgtgaatacatgacttacagacttagcttgagtaaagatacttgaaaatgaacaccatttcttggctatcttcctattttgatgtacccttcaggcctatgaattttagtataatagataaccaataattatttcttggttctttcctgcacatctgaataaccctatgcaaagtgatagaatgtttttctataaggaggtcctacactggagattgtgtatttcttaatgctgttgaaggaagagatgtgtatctaaaataaatagactctaacaaacattaatttatatttctattatctgttttgtgtattgagatatctcacaaaaataactaaacattttggcattattgatattacatatttgccatgaatatttgtaaatgaagaaaaatatatatacatcagtaattatcttggcaaactcttcaattatgcaatattgttacatagattacatatctaagtgaacactggagttttaacaatattgtgtgttcataaatgttttatttattattgccactaattcttattgccatttcaagaactatgtataagttgttctaaaaactattaaagtataggtgaccatggtcactactgcctactttggtaaaggccaaatatgtgaagactttttaatgtgttaacaaacgttgaaggttttttaacctgttaacaatcagtaggactcttgaaattatttcctaagagagtaaattttacaacttgcaaagcatgattaacctcttgtaattataaaccatctcttgtagttatgtagcattttgttaatgagcaaagaaccattgtggttcctttttacatttcttaaaataattctccgtaacctcattgatatctccagtaaatttagataagcttttttttttaaaggagggttaaaatgacattttaaactaatttttcttgttagttatacagagttgaactatctgagggttttattgacagtcataaaaaatttgttattttctgtgaaatatagagaatttaattcattatcatattattaattctgtgggccattgtcttaattctagaggcacaagctgttttcatcccactgaaatagaggaatcaaagtatgttccttgctcaaagcacaaaagtgacatactacatagtatgcttcttgagtagtcgtaaatctcatgtgttaaattacatcccaaagatttcagtatgttttatgactttaataatttatggtaatttctaatctggcctttgttgacctgtcttgctttttaaatttttagtttttcgacaaaataattaacatattttaataatcttccaaaggtgtttaaaatggcattgtatagagatagctgaaggcttttgagcttctgtgttgtaaacactttcttaataaaacatgaattgctaccagatgatccagcaatcccactactgggcatttatccaaagaaaaggaaatcagtatctttgaagagatagctttgttcccatgtttactgcagcacttttcatactagccatgatatggaatcaacctaaacgtccatcagtggatgaattgaaaagaaaatgtggtatgaaacagaaattgctgctttaatttatattaaacacactcatattcttctcagctgttaagtattgagttatagatttaaagaattctattgtgaagactaaagtgactattaaagtaagaaattattttttccattatatttaacttatttcatactttaatgttagcgccaatgagcaagactattgaatacaaaaactaattaagtagtggtgatagtacagtatataagggagaacattcttttagaaaggaacaataacagggagcaatagaaacaatgaatgagtgtaaggtcacttagtgttaaaacagctaaaatatagtacaaataagttgcgttttaatagtgattttatataattacaccttgatgttttatttgttacaagaattgtccaggaagatttctctaaagaccaaaggcactcttcccctaaataactccaaagccagtcctgtgtttctataaaaaaaaaaaaaaaaaaaaaaaaaaaaaaaaagtgaaaataacgtgatgaacatttttgaggaagtataaaaccaaaatactccactgcatagctgtttctgcaggtattgtattgatatattacattattcagctttggagtctccacatccaatgttacatcatcactctaaattaaacatgtatagataaatgaaataaatgagatagcatatgaaaatctcatagcccagcccctgcactatttaaaatagaaataccaaagaattgtattcctcatctgaaagctatttagtggtggtgtttcaaataaaaattccatctactgctgttgcttccattgtatctttttctctgcggtactgaaagagaaagagacccagaaggggccttgtctgaagtgtccctcttttaagctgttgctgctttaagcacagggtggacaaatgtaataggagtttcataaaggtggaataaaccagcggattacggtgtgggtgaatactttcagatgttaaccaggagctctgcttgcatgctgggagttgcccatgcctcttctagattgaggcacattatcatgcacaacctaactccaagaaatcttttaaaccactggaaattgaacccagaacatgtctctaagccagccttttcatcctgacaccgaatcatagcatgagccagtctgtcagggatgctgctgctctctaggcaaattttaaatgttgaaataatgaatcatgttttcttgaaaaccatgtacaccaaagaaaagttagtcattttatagatgatgaatattaacattttcttagacaatctgataaattatcagatctcacttttggctctttttaagacagttatgcctcagaaatattaataaacccccaagcccttatactgatcagtatgttcactactagctatgagaaattcttgaagttcttgtaattattgtattatttccttactttcattttattagtatgtgaataatatttttaaaaattctagtgtatgtcttgtatatattttaacaacatgacttttaattaatgtcttgataacatttcttctagtgtatgttttcagtaacatgattattaactgtaactttaaaaacctgtggattagatgggaccattttaaaatgttttaaacctggaaaatctgatggctttaggtttagttcaagctatagatcacctgtggagaatggaactgccaaaaaaaaaaatagctgtagcagccctttgagtattctaaaatagggatgttatccagagcattggtttctaaagcttccattatttattgatgttgagctttcaggatttagctacaatatttactcaacatctaagccatgcttttttatcagtcatgttttatatcttttataatcaaactgcttatcactgaaaaaaatatataagtttctatgtatctggaagaattctctggtgtttcttagatatggattttgatgtgtggaataagaattcaattcaaggataacagagatgttgtcctgaaaaaaatcgaagaaaatcagcttttctttaacattctgtcaaagctcctgactattagtttatcagcactgttttgccaaaggtgtcttctcttctcttctttgaaaaaaatcatctgctgctgctacgccgcaagtgtgttcccgctgtgcctgagaagatgtgtggcataaaaaaatgggcatggcctgagttaaaagtgctacatttaagccagagctggcttatttattagttgtctaatcataggaaaatgacagagcatgcttttctcttgcaatatccgttgctgaaaattaaacacatgagcagagctttcagagaggttgactggcctctcagacagcacctcataggatggcctgtgttgaagcatctcctttaaccagggtctgtccctcagcattgggttggctcacctagattggattgtcccagcagaaaaaaaaaacccaaaattcagaatcatatccaaaccggaatactctttcattcacattacttgtactaccttttcagaaactggatacctgagtgtgtgagggtaacttagaaacttatctcatggttagaagttttagaattagagagcgatgatcatgaaacggacttcatgatcagaagcaatggagcaaggaatgagatgtctttgaggagtatttccctgaggctgtggataacgctgacgaataatccccaccttaaaagtgggttgaccactctagtagctgtaaggtgggagggttctttcttcagagataaatctgtgctcttcacttgcccatttcccaggttttcatgtaggtagaagaaacacctgtaatctgaagacactcttccttcagctttgttagtgacagggatttaaatatgtctttcacacattttccttagatagttaaatttcacttttcctgtttgtttttctctgaaggtattctaactcccctcctaatggacttctagagctttctaattctatgcaatttctgttgatttgttctggtaaactttgaaggtaatctctgattcaacttcttggagattctatcatgtcatctctgtttattaactttatgttactcatggtttcttgatgaggactcattaaacataatgtaagtagaaaattattaactacataatatttactacgggttgttatttctgatagtagctagctgtaagattccaattgttcttcaaatctttgtctcagtgatctctgtgtagttcttgactacttcaaataacttcctagaaggatagggatttaataatctcttaataggaacacttaacacactgctggtgggaacgtaaattagttcggtcgttgaaagcagtgtggtgatttctcaaataacttacaaaagaattaccatttgacccagcaatcccattattgggcatatacccagaggaatagaaatcattctaccataaagacatatgcacgttgtgtatgttcattgcaacactactcacaatagcaaagacatggattcaacttaaatgcctatcaatgaacagactgaataaagaaaatgtggtacatatacaccatggaatactatgtggccatgaaaaagaatgagatcatgtcctttgcagcgacatggatggagccagtggccattatccttagcaaacttatatggaaacagaaaaccaaatactgcgtgttctcacttataaatggaagctaaatgatgagaacatatggacacaaagaggggaataacacacactggggcctactggagggtggaacacaagtggagggagaagatcaggaaaaataattattgggtactatgtttagtacctgcgtgagaaaataatctttacaccaaacccccgcaaaatgcagttcacctgtatagcaaacctgcacgtgtacccctgaacctaatttaaaagttataaaataaacgtatcttattttcagtacaatacaccacagagtagaagggttaaaagagattgcttctgaggaggtgagatgggggtaaggacagcacaagagcattttggggggtgatgaagctgttctgtgtcttgcctgcgatgatggctacacgactaagcccttgtcagaactcacagaactttacttcaaaaggagcggattttactacacatcaattccaataacaaatactttgtctttaagcaaagggatacctaaatatagcgtattgaatggatctccagaaaaacacatttttcagttcatgtttcagcctaggcctcatctcatccaggaaaccttgtcttgcttgcctttacatacatgtggcaatcagtagtttcttttagggctcggactgaacactcaatgaacttcaatcttagcgcttgtcgtagcagattgacatggtttatttatatgtgtcattctctgtagtaaaaggaaaggatcaaggccattcacttttgtagtgattgtgcatggcagtatttggcacatagtagattattaattatggaacttctgttttcacacacacacacacacacacacacacacacacttcagagctattttcatttaaatatttgctttagtctccaaagcccctctgcctcaacaccaacccttctatctcattattcatcagcttttctcctattacgaaactacttaggaaagcccacttatttagcttatgatggcaaaaataaatatttgtacttttttttttttttttagtcatcgcttcatagaacagcctctgtcctctgcttatgccatgtctgaatatatgctggaggtaaaaagagttcctggttgagagcttcaatttgagaaactatctgagattactttccaggttccaccgtggaacctgtctgaccttgaacaaatgacctcgaacaagtggctgaaatctcttctatttcgtcaactgtaaaatgggggaaaaccatgtctatctcatggggttcatgtgaaggttaagaaattgcttattcagtgtttagcacagtgcctgatatgcataaagctcctaggaatattagctgttattgtatttccttaaagaagcccatagctctatatgccctttcattatatgttttagtagcccaatttaacatatggataaaatatttttaagttaaatgatttgctaatggattgttgaacgagtggcagacacccatattatagacgaaggtcaagtccataacatacagtacatttccccactttcatttcccattaccaaaattcattattctcctgagaaactcattatagaattcatgtcagattcatctgtgtgttcccagcagtgccttatatccagaaataacactgagtcattgtctagatgtagcagaggtggaatcctccaaagagaagcctcagagtggccaggtttgccaagtatagggatgccttgattactggccttactctttatgctcgtgaattcctaagttttattcctcctgtagtcatagattggcttttaagctacaagctgaagagagagaaaacctcttccacctcgttggaatatgtctcttcaatccatttgagccaatttaggacatgagactgctcttagtctagaaccagtcatcaggagaattccaggtctgattgactcggactagcgggtcaatatcagggcaaaaattccaacgcacaacacgatgtatcagtaaggagaacctcaaaattatttcttaacgtccagatcatgttcctatttttatatatctattttctcacataagtcattaaaatgatgtacctgtgcgggtcctttaatgatactcaaagatcttgaattataggctaataactaacttaataagctgcagaaattaacatttctgctacgtttatgtagcattttcccacatgtacttcagaggcttgagaaaagaccctgaaataatgactgaataacagctttactcacttaatttcaaatttgttaattcttctgggaaataccgtcaacatccattttattatttttctcaattacatgtacgtttctacatcagtggataagttaaggagaagaattccctcatgataattttttcatgctcgaaaattttgaatcaattttttattttacattatactctttcctagtcattagaaagggagtggtggttaagataggcaagaatgctttataaggatactactctcgtttcaattcttaacatcaaaaaccttaacagtgtgtagactataaaataaaatatctagggatcagagcattgtgctgaactttgcaggttttttagtcaataatatatatgacgtgttcacagaattctttgtcaacaaagtacttttggagctccaggccatttaagttggtttttgtactttttctttttcttcggaagactttttttgttctatttacctggaagtgtttcttttttggtactgtgaattaaaatgagaccaatctactaggcaggaaaaaaccttaattagattgttgacacagacaaataagaatgtcaattagcatctactgtcacatgcctctccagactgcttctaggatgagtggcctcaagcagctacatcatctttatactcctaaagcatcaaggaaacttggagtgacaattcatatcatgaacacatccacagtgatgatgattgtgcttcttcccccccacccaacaacaaaggatgaatgccaattaatgtattcagttttttgcgtcaaaggctggatcacttgtgcaatgagggtaatcatcctgaccagacaggccatacaatccatattgtgtgaattaaagataatatgcgtgaaacaccttactctggatgtggttcatagcagtagcaaaaagatgaaaactatggtatgctaacattttagagatctgtactctattttaaataattttataaaagtgcatatacaataaaaagtgcacgtatcacaagtatatgcctcaaaatctaaagccagtcatgtaatcagcatccacttcaagaaagaaaacaaaacagtacccctggttcctctttgcaatcattagtctcccaagagtaatcaccgatctgatctgtgacagcatagattggttttgccctactatatttttgctgaattatacaatatatgctctttaatgtctggcttcttagtgcattgtatttgtgtatcagctattctcttgtgtgtagttattaaacaatcattttatgggctgcataatattccatagggtaaatataacagttttattgataacttagctattacaaatagtgctgttgcagacatatattctattacatgtcttttggtataagaatttacacatttcacatgggtgtatacccagaactgagattgctaaatattggggcacattgtatacattttgatttagtagataagatattgccagatatcgtaaatgcacagtttgataaatatagagatttatactttttctagagaaaagccatcaatatcagtgtatgtgtatatatatacgcgtgtgtatatatacgtatatatatacgcgtgtgtatatatacgtatatatacacacatatatatacgtatatatgtgtatatatatacgtatatatatacacatatatacatatatgtgtgtgtgtatatatatatatgaaacaactcagaagcagaaagataccccatgttctcacttataagtgaaagacaaataatgtataaacatgtacacatggacatagagtgtgtagtgataagcattggagactgaagtgtgggggtgtgcaagggaatcagtgataaattaatggctacaatgtacataatttgggtgatggatacactaaaaatccaaagttcaccactatccaacatactcacataataaaattgcacttgtaccccttacattcatacaaataaaaaattatttaaataaaaataaatatgtgtatatgtatgcatacatacatatgcatatacatatgtgtttgtgtgtgtgtatataacttacacttaaaataagcatggatgctgcaatgaatgctcaatttacaagggttgtccatccaaacttgtggcaagtatctcacctctcaagttgttttcttttttcttcatatatttcttgcttttgtctaggaaggaataatttggcttgcctttcaagagtgtacagtcagcatgataacccaaacacttaagacacgtgctaacccatgtggatcccttgagagaaggaaaacagtggtccttttactgggcagatagagcccggggccaggtttcgtggcttgaagatttcagcttctctgcgcctctcagctcagtgcctctggaagcaatttacaacttgtgaggccatactcaaaggccctgttattaattccccgccttccgagaccccatttcagaggatctcaattgctctcagagtgaatttactgtttcctgaattccgtaatcccaatagcaggtctgttgtcctcattagatagcttaagttagagtcggcagtgtaattggcaactgagctactaagtatccaatgcttatgtggaaaatatgttccctattgcaaacaactgatattcatattcaatttggcaccatcatctatctataaagcagatactacttgtgtttattaagttttatcccaaataattattttagtaataatgcttgaaaataggccttggtcatttgcatgtctgtatatggcatatcctgagtctttgtatgtattagaaagatcactcgttttgacttgatggtttaataaaagatgtccctcactttgggcagagacatttgaaaaaggcactccaaccagggacctaagaggtgaatgagatgcagctctgaatcaggtcacacggcctcaggaaggaaacatcttggttttcacatccctcacttctcgatgtcatgtgcaatacacaaatgacccctcaacacacacacaggcacatacacaaacacacactcactcactcactgtattgtctctttccttgactaagtccttcttactaactcaagctctaaagcttttttacttacctaaggtgagtgtgtgaggatttgaggtttcaatattaaaattcagaaacatttaaagttcattttaaatattagtaaaaaaaaatcttgacaaaatacaattatagacaaaaagaaaattcagaatatttggaatttaaggttgaggttacagccctatttatgaaatattagaagaaaaatgctggagagaataaagcaggtttatgagtctgatagaaagcataaccagatgattatgcatatatttgcatatgcaaagctttctaggcaatctgaacatttaaacctacaaatgtggctgcgatgaacagccacagaagagcaggctagaacagaagaggaggctagaacagaagagcaggcagaagttgtaaatgaaatgttaattttcaatggttgatctcccaagtactggaacagatttgtgctgttttcaaggttttggttcaaagaatccagtagtgtattgaattgttttgtggcacttccctgttattttgctttgtaagctacctcaatccatgaagtggctatgagccccttatacaacactgttgatttttttttccttatctacgcaaaagatttttgattcagggccaggcatggtggctcacgcctgtaatcccagcactttgggaggccgaggcaggcggatcatgaggtcaggagatagagaccatcctggctaacacggtgaaaacccacctctactacaaatacaaaaaatcagccgggcgtagtggcatgtgccggtagtcccagctactcgggaggctgaggcaggagaatcacttgaacccggtagccgagatcctgccactccactccagcctgggcgacagagccagactccatctcaaaaaaagaaaaaaaaaaaagattttttattcaggtggctatcagactcattaaatagaagccttaggttaagttcacgggttgctagttggaagcctccatggactatgttcataaaataatagaaaggagttatgcaggacttcttgaaatgttatttaaaaagtcagaataggctttctattacttgtctgaggtcaaatacatgtagtgctttctgaccatttcatccagggtgttagctaggacaataagaggtgcttaaaaattattagattgagtaaatgagaaagcccttagaaacataggaacagaatgacccttgctttggatctaatattgactcccacgcctaaatccctttggagaactcctttattttctcttccatcaagagcaggtataaattaaaaacaccattaaaggggccatctagctcagctgaagctttcatcacacatgtaggggaggtatggttgggagggatctttttatcctttaggtcttcaatttacataggacttttgaataatcaaatagccccaaagagctgatcttaggactagttgtaattgagactatttctccatggggtagaaaaatctagttgtaggaaaactgagaagtagatgtatgttaacctcaaaggctgttttttacaaaggatgttaaagcatcatctttgctcagaaagggagcaataaaacaaatgagtggaaataacaaaaggaaataatggccaggtgcagtgcctcacactagtaatcccaacactggggggctgtggtgtaaggatcgcttgaggctagcagttcaagaccagcctgagtaaaataggcctcatctctacaaaatagatagatagatagatagatagatagatagatagatagatagatagccgggcgaggtagtgtgcccctgtagccccagctactcaggaggctgagatgggagaatcgtttgagcccatgaggtcaagtctatggtgagctgtgctccctcctgccactgcactccagcctgggtgacagagtgagatcctgtctcgaaaacaaaaggcatactttttagatgtaatggaatagagtacttccaaacctggctgcctgctggagttgtattggaagaggttgcacgacttcagtggagatggcctagatgcctgctcagcagtcatctagttaaagcaactaagaacatgtaatatgaaactgcaaaaagagatcgtgtacgtaaaatcactctgggctcctcagatagagtaataaacacaactcctgacagccaaataaaaagagaaataatacagcccttgacttccttggttgctttgacatactaagtaggtgttacaggttgggttctctgggaaacagactctaaaacatttttatttttactttatttgttgttattattattattattattattttagacagaattttgctctcgttgtccatgttggagtgtaatggcacaatctcgtctcactgtaatttccgccttatgggttcaagtgattcttctgcctcaaactcccaagtatctgggattacaggcaagtactaccacgcctggctaattttgtatttttagtagagacggggtttcatcatgttggtcaggctggtctcaaacacccgacctcaggtgatccacccacttctgcctcccaaagtgctgggattacaggcgtgagccactacgcccggccagactctaaaataaagtttaatatgcagaatacttatcagggaatgcccactggaccaatacatattcaagagagggcttagaagcaggattggacagaaagagaagttgagctgtaatgcaggcccaataacagccttagtgttaagcaggctgagagattcagcagttaatgagacagtcaacccaaacagttttataggcatcaaaagtatgatcagcatggtgtcagtttcctgtgtcacttgtcccacagtatgataccaaaattaaagagaccagatgacatgcaacacaagcagtgtgcactctgttgttgagaagccaatttcgtcatgcaattaagcagttttatactctgcagctgtactttaaggggagctgagatggaacatcatatgtctcaccataaccagaaaggcagatgagaaatgttctatcgccacctcccacaaggtaagggacttccctaaagatacagaggtgggtggaatattgccttggtagacttcctctcaagactgcctatcttcccatgttggaaggatcacagagcatttgtcaagacgtgggtcaatctgcagttgaactttgtgtatgtggcctatgtggatacttataatatcattgggcacctccatagagctgtttcccaattgaccaaacatatgggaagcttcagagcttcgaatgacccttcagagtagtcctgagaacagtgagccttactactcctgcattaatcagtcattggatgatagccttctcagaaataagtcatgaccttgtgcaagggggctcttcatggctgggaccacccctaaaactgagagctgaaggctgtctgccaccagcccttccacctgctgggacaagttctttattgaagggaaatctgagtagttcatcagcgtccatcacagtagtcaagccgttcattcttccttcttatgacaacattgtgcttattgttatgtaatccctttccagaacattttaggttaagttttaaaaataatgcatataaatagacaattcaaatactggggaaaaaaagcttgcacttatattgttatagaaatgtgcacacttaaagagctgatttcttctgggtatttacataactttatttaaaaatccatccatttttaattagctgtttttaatatgcagttagctaagatattataagccatatattaggctaatggacatttaacagcttagttaagttcttttaatggaaatgctgacaaacctttgtctgtaattatagcaacactgtgattacagaaggaggtgcctctccttgttgtttgcagccctaaaattccatgtggctataagtaacaaagtccattattagataaacacaagtcatacttggcattacttgcattactcgtctccttgctttatttgaatcattttttaaagttgtaaaatgtttttcaaaactcagaatagtggccagttaataatatgattcctcttatattatgagattttaaaaaatagttcaccagtttctggtggcctctatacccattggcaagtcctagccattgtgaattaagtaaacaattctttatggaaattttttaatccttaaaccctataagtttttattcatcatgtcaggtcacttgtcaaagggtttaacattcagaattcaacaaaagtttatcaaacacctattacaggacgtgcaattttgggcgcactgggatttcagcaattaacaatcaagatatgatttgtatcgacatggatattacattctctcacaggagacagaaaacaaaataactagaaaatatacataaagagactttaaaatggggtaaaattacagattgtgacaggatgaccactttggttcagaatatctaggacatttttttctttttttttcccctccctccctctttcttttttttctttttctttttctttcttttctttctttttctttctgcctttcggagtcttgctctgttgcccaggctggagcgcagtggtgcaatctcagctcactgcaacctctgcctcccatgttcaagcttttcgtgtgcctccgcctcccaaataactgggactagaggcatgcaccaccaggcccagctgatttttgtatttttagtagagatggggtttgaccatgttgcccaggctggtctcaaacttctgacctcaagcgatccacccgcctcagcctcccaaagtgctgggatttacaggcgtgacccaccaggcccaagcaaggacatttttttctgagccatgttatttaaacagagatctgaatgacaagaaggggccagctctgtgatgtaggggaagaaaaatatgttccttctacccttctaggctgcccagctggagtcctacaaagttagagtgacaaaagacagattaacaagaggaaaagcctagaagtttattaaaatattcagtgcacatacacctggtagaaactcagtgatgagtaactcaaaggggtggttagaatgttgggtttatatagcatctgaacaaagaacagtaaacttgtagagaaatgacaaaacaaagaaaaaaggggtttaggtatttagggttgccaaactgtaggaaggtaaatatatgggagaaacatggagtatagtttgtttatgccaagtctatcttgagatcaacttttcgtattcttcatggccataacaatttcccaggagagagggcttatagcagttatcatttctcagaagtttctgcttttatttagacaagggaagcactgggaaggcttctttttgcttatattgattcttacttgcctctaactaaaagtaatctttatgtcaaagtgccatattttggagtggtatatattgatctcctataataacaatcaaaaggaacagtattctaggcaggagtaccactaatgcatagtgtttggtgtaaagacaagttaacatattcatggggcaacaacaacaataagccaatatggctaagacattgaggatgagtgagttggagaagtaggcaatggccagctcatataaagacttgttcgtttttataaattgtttagattttattgtaattatggtggcaagtgattggagagtattagcttcactttgactggcttatcgaaaacggaatgtagggggtgaaagtggaataaaaagaccagtcattaattgagtagtccgtgtgagagatgatagtggcttggacaaggacgattgtactggagagattgaagcgactgatttcagatttgtagtcaacaaggcttaattggtaggagaaaaaaataaatcagtgttaactctttaatgtttaacttgaataattatgatgagggtattaccatttattgagatgtagaatattataaagtaagagcagatttgttcaaaaagtatcaagaatctttatttggacatgctagtttggggatgcttattagagaccctaggaaactgaatataaatgtggattttagagaagagcttagggctggcagatgcacattaaggatctgtctagagccatggcgctagagacctccaggagaacataaatagtctcaagatcaagccctgagacactcagatgtttagaagtggaacagaagagggacatccaatatagaataccaagaattaggaggggaatcaagagagtgtggcaatatgaaagatacaaaaagagtgttgaagggagggagtaattaataaccagcatgttatgaggggctcagtataatgaaaagataagtgactattggatttggcaacatataattttttggtgatctggacaagagcaatttgaacagaatgatggatatggaaggtccagaggagtaggctgagtaaataatataaggtgggaaaatagatacaaagattatagacaactttttcaagaagttttactgtgaaggggcacagcaagctgagacagtgaggataaataatagactcaaggatggtaactttagaataagaaatttcaatctgatgggatttaagtgttagcaaggaagctttaagaagttattttccccattagaatgatctgaaaaatgttttagaacattcctcttatattctattttatcacatttatataactttcagagaattgaaagaggtattaagttattatgaaattttctgagattaataagataacaattataggatgttttcttttagttgaaatacacctactcagcctaatttttataacttcttactgaagtataatatacttcagtagaaaagcatgcctaatataaaggtgcagctagatgaatttgcacaaactgaacacatccctttaaccagcacttagattaaaaacagaaccttgatgatacctcagaggcccccttctgccccttttcagtctctccgtgctacccccatggataagcattatcgtgatttctaataccatagattaattttgccagtttttgaattttatgcaaatggatctatttcacctaattgtaaatatataacattgtcatagcaaggcactcattgccttacactgaaaattacattgactctttgccacaagcttagacttgctttctcattttattatcatcaagcctatagctttcacactataccttgttcctgctcttccctactctatttcttggtagatattctatatcagtcttagagtgcagtttgcagaacccctccatcagaatctcctagggagcttgttaataatgcagattcctaggcccctcccatggtttatgaatctgagagtgaggcagacaagactataccctctcatgcctctataatgtaataatgtcttcctagaatgttctttgctgcatctcttattaaagaaatcttatgggccgggcagggtggctcacgcctgtaatcccagcactttgggagcctgaggcgggcggatcacatggtcaagagatcgagaccatcctggctaacacggtgaaaccccatctctactaaaaatataaaaaattagccgggcgtgctggcaggcgcctgtagtcccagctactcgggaggctgaggcaggaaaatggtgtgaacccgggaggtggagcttgcagtgagctgagatcacgacactccactccagcctgggtgacagagcgagactctgtctcaaaaaaaaaaaaaagaaagaaagaaaaaaagaagtcttatgtttcctttatggccagagcacaacattgtcatgaagtcatctaaaatttcccactagaggtaacatctccttcccctgtctagctcttttaaagcattacctccatttgccttgtatcatagctgcttgtacacctgtctgtctttccgctgaggttataatcctctggagggtcatgactttgcattcctttgtgtctcccattagcagccagcacagtgccttgcatactgttagttctaaataacttctctctctctctctctctctttttttttttttttttttttttttttttttttttgagacagagtctcgttctgtcacccaggctggagtgcagtgcaatggcatggtcacagctcactgcaacctccccatcgtgggctcaaatgattctcctgcctctgtcttccagtagctgggattataagtgtctgccaccacgcctggctaatttttgtatctttagtggagacggggtttcaccatgttgcccaggctggtctcgaactcctggtctcaagcagtctgccctactcggcctcccaaagtgctgagattacaggcgtcagctgctgcgcgcatccctaaataaacttttttttttttggcatgaaatctgtaacactggaaagatgttattgccttagaataattaagagattaaatgtagaatctcaaaaacattcatttttttccatgaaaactttaccaggcctcaagggataggaaaattatgggtacagaattgagaatctgtaggaacttgcaagataaacaacggtttcacaagaaagaccttgttggagagttaaattttcagacagttgtaataacttcacattaaagttttgtcaaaaaataagtatctgcatgttttgtttgccttccaatgccctcattttatttgattttttcccataagtaactatagtgaaagcacgaaaatgtgtttctgtgtttgtgtgcctgtatgttaattgtgactgtttctattgcattgttattgcagaacctaggcacgcactctgtaggcttgggtgctttctccaactgaaaaaaatcctacatatggataaattatttttacagccagtgtttaattttacaagtggtccccctccttctgtttttaggatggcagagagaatacatatttacttaccattatcacttactcatgctttgagcttgaaggaaatgagacagaaaaatgaagtaacattaacttctctctggaactatgtttctcatattagagctttatctgaggagttcacttcctctctcttcaatgctttgttcctctccagtcgattcaaatgtcctcttaaagcagaagttccgaacctctttctgtgacttcaggagagcatgagaatgtaaatataagttttaggactaaattttcaaagactttttccactcagctctcttttcctcttcggtttgttgttgtcgttgttgttgttgtcgttgttgttgttgctgctgctgctgctgtttttccccttccacttccgtaactgagctcttagggtccatctggaatctgattgcaattaaaaaaaaaaaagtttatttttacctccttgtacgtgctttctcctaaagcaggagtcagaagccttttttctttgaagggctagttagtaaatattttaggcttgtcgtctttgtcgcaattactcaactacgctgttgtagtatgaaagcagacaatacatacctgaatgagcatggttttgttcctagcaaactttacgcacagagaaatttggatatcgtataatttttatgtgttgcaaagttgtattattcttttgatttctccccaaccatttaatatgtaaatcccattcttagcttgtgtgccatacgcacacaggcagcaaatgcgagttgtcacacaggctatagtttctgactttatgtcttaaagtaaacagtaataatcattctctttttccaaacagtccactaatctccctttgtattcagcccttgcatagtaaacgccgtttcttcatcatcctgatttttattctgagaaaatactgtatattgttcccatgcactagggttcggggaaatttaaaaggatgtaggatctccttttcattggtcctaaaattgcactggggaggcaggtcatgtttatgaacagataaatagtatcataatataatcatgcatttctatggctagcatttagaactatagcttttgatgtcatgtggtttttatatggttgattatttttttcttatttataaaatgaaaaagtttgagaatttttcatctccttaatgtattcccttatttgagggaaaagtatttacctactacataggaatttatcttaaaattttctttgtctatctatttttatggaatataatcgagcaactattttactaattaatactttaatatcattatgaaaatgttctcatatttttaaccttataagatcagataattgctatgccaatctatggttgaaatgggttcttatacttaacgctatgctctttcttctgagatgtaaaaatatgtttaaatcagaatttatataggtgtcaattcaaaatgacagtagttcattattttgattagtataaatgttcacaactaattctattctcttatctattaagtcaccaaataaagtatatttgttttaaatatttaacagtttaaattattctttgaaaacttatgagtctaaagtaagaacaattaacccattcattttgcaagtgggatagttgaattttacttgcaatccagggatttttgacagtttgaaatatacatacataccatgtatgtttaggaaaacatttaaaaagagggggttgtaaaataataatagttcttccatgattttttagccataatgtttataatataaaatatgtatactcttgttattgaatgtagtatgtttctaatttaccagaaggcaagagaataatcctggagaatttctcaaggcatcttcgaactctttgatttattgctcacatatagtaatttgccaaatgacgccctagtgaactgaaagaattaatgccccgtcctaagtcactttcaccgagggactgaaaacctgcagcattttgccaattagaggaggaaacaatctaccttgcagagtcaggagtactggataaaggagctaagagtgttgctttttttccccttcttactttaaaaatcccaattcatcccatgtctttcttaaaggctaagtgaagtagtaagtacgtttttgcaacatacgaatttagcagactggccttgtgtttatttttggccggaaccattacacttatttccaaccctctcctttatttgttggttgataatgggctaattttgaatctttactgtcaaaagaacattaagagaagcagccctgcctgcatcgcaggctatgtctgtcctttgccgagtattaaacactaaaaaaaaattaagaaaatactaacaaaatgacaaagcattaagaaaataaaactagatgttaaaggaaatgagaaaataggaaaggatgctgtacctggagtgattttttttccccaggctacctaagatgatcaaaaaagagctaatttctcttaggtttctattaaggaattactagaatatcgggcacaccaggaaactttatcagtggacctgtcctgaaccaaattttcttaatgtatatatgataatttgttaccacatcccagattattttacaggaattaaaatatatttgaaacactgacagggaaaattgggtaagacattgatagatactacaatctgtacttgaaactgcactcaaggaattcgttagtcaagaaagaacacaatgactgtgggcccctctgggttttggaacctcttttgtaaagcatttttttttttcccaaatagaagatattatttttgaaaaggttaaataaaaaatctttgttcactatatagtttcctcctaaggagtaaattaatttatataaaatattgcaatataaataacaattttaaaatctcaaaagagcagtgttttaaaaataatgtagaaacattaagaaatgacttcaaatgataagaatgtcattggagagcaaagggtttttaatattacatatcgtggcacgtatatcagcacccaaccgctcaagatacagagttctttacaaaaatcaaacagaaggaaatgtgccaccttgttcataaactatatttaataataagccaggcagataaagtcactttcacaaataatgagcaagcccatggtaatataattcatttacaataagatttatctcatggaattcttagactgtgctttgaaatttaaataattctgataaatgccaacagaatagagaaatcaattccagagcaattactaacacgttgcattacctttctaacattaatatttctcttcatacatatcattgaagagaaaatgaggatggaaaataaaaagatcaggtaatatatttgctttctcatctagggttgttatgatcttcaagatgaagttttattttttactcctagcaaatgatattcttttttattttagtttttattattttatttttctgtaaattattggggtacaggtggtatttggttacatgagtaagttcttttttttgatatttctgagattttttttttattctactttaagttttagggtacatgtgcacaacgtgcaggtttgttacgtatgtatacatgtgccatgttggtgtgctgcacccattaactcgtcatttagcattaggtatatctcctaatgctatccctcccccctccccccaccccacaacaggccccggtgtgtgatgttccccttcctgtgtccatgtgttctcattgttcaattcccacctatgagcgagaacatgcggtgtttggttttttgtccttgcgatagtttgctgagaaaaccacgaggtaccatctcacgccagttagaatggcgatcattaaaaatcaggaaacaacaggtgctggtgaggatgtggagaaacaggaacacttttacactgttggtgggactgtaaactagttcaaccattgtggaagtcagtgtggcgattcctcaggcatctagaactagaattaccatttgacccagccatcccattactgggtatatacccaaaggattataaatcatgctgctgtaaagacacatgcacatgtatgtttattgcggcactattcacaatagcaaagacttggaaccaacccaaatgtccgacaatgatagactggattaagaaaatgtggcacatatacaccatggaatactgtgcagccataaaaaaggatgagttcacgtcctttgtagggacatggatgaagctggaaaccatcattctcagcaaactattgcaatgagtaagttctttagtggtaatttgtgagatcctggtgcacccatcacacgagtagtatacactgcaccatatatgttatcttttgtccctcggcaccccttttctaccccccaagtctccaaagcccattgtatcattcttatgcctttgcatcctcatagcttagctcccacgtatcagtgagaacatatgctgtttggttttccattcctgagttacttcacttacaatgatagtctccaatcgcatccaggtcattgcaaatgctgttaattcattcctttttatggctgagtagtattcatatatatatatatagacacacgtacatacatatgtatatataccgcagtttctttatctacttgtcgattgatgggcatttgggttgatacttgcacacacatgtttatagcagcataattcacaattgcaagtgatattctcaggaagcatgatgtaagtgacagagacttactttgtagactgcactcattcacttgttctctgaatgtgctctaggcagcctgagtttctactatgtcagtgttacatagatgagaaaccccatgggtggtttccacagaggctgcaatactatttttgataccaaaaatctgtttggttttgtgagccccagatgcccatatggaaaactgaagtgttgatacctctttgtagccctctgatgaactgcatggttcaccttcctcagcagtttgagcggggtggggagagcgcctgcttcctagccatccgattggcctgaatcatcaaaaatgctatcatgaaacaggttctgtttatctgctccagattacacccatcatgttctagagtgctggtttcatgcttgaatctagatcaagcctgctttcctcccctgcctgtactccctgtggctacctacagtcctgctgctgacagataatctaaaccaatagcacctaattagcctatttgctcatgtgttttttccatcgtggtataatgtcctccttgtcaatttagggtgaaaatgtagcaacacgttgctgatggtttaatttctggaatgcaggtaatgaatgtgtttttgcttatccaagtcttcccatcagatgtcaaatatagaagaacagtgttcagaggtcctaaatttaaattggagtgagaaattcacagcgcccctgaactcaggcaaaatgcactctgacaagtcaaccagatattcacagatggtctggaggatttgaagcctaatttggtgaaataaaattaaatgagtgaaattgtatgcagtcattaatctatcaccatacttaaaatgcttcattgaaatttcttttactgcttcaaatgaaaaaagatcaaactatgttatagaaaagcattcaaaacccttacataacatagataaaacttggttggagacttacagaactttctctgctgcttcgagaaagttacagtgcccacaaatctattgctattagaatattttattgtattcaacactcaattctaccataattatgtatatgagaaaaatatttttacctataaaataattattattaccttttaaaaatctgacattcttccttttttctaaagaaacatatttagatttagcttttattttatttttgtgttgatacatagagattgtacatatttctaagattctagtgatattttgatacaagcgtataatgtgtaatgatcaaatcagggtaattgggatatccaccatctgaaacacttatcatttcttcttttcaatgccatcataccaaaaggaagtaaatagaatttcaaatataaggacagccatgattttacatacatgcctacgattccaccacaaaccataattacgtcccccaaacttttaacatttcagatactttgtcccaggtatttcatgataaggattgggctatgactctgttacagaagggccaaatgactaaaatgtctctgaacaatattgattgcaaatattctacccagttgtcaggtcaatatgttccaattcggaatttataacattgtatctctactcccaaaccatccaatctcacctacctcacttccatattatggtgggtgatctcagattatatttaagctcatggttacttgtcaagtagatatggagtttagcctaacttttgaaatttatgctgagattacccttctcattatagaattaagtaggcagtttccaagtttagatttagcaggcagtttttttcaaatcacttaaaagttatatttttttagggcattgaacaggtttgaaatcctaccaagatgtcatgtacacatagaccaatagaacagaatagagaacacataaataaaactgcacagctacagccaactgttcgtcgacaaagtcaacaaaaaaataagcattgggaaatggattaaagatttaaatgtaagacttcaagctataagaatcctagaataaaatctgggaaataccattctggacattggcttgggaaagaatttttgactaagtccttaaaagcaattgcaaaaaaaaaaaaaaaaaaaaaatgacaagcaaggacttactaaaataaagagcttctgcatggcaaaataaatgatcaacagagtaaacagacaaacaccaaatgggagaaaacttttgcaagttatgcatctgacggtggtgtaatatccagaatctatgaggaacctaaacaattgaacaaacaaaaatcataaaacatcatttaaaaaatgggcaaaagacatgaacagacatttctcaaaagaagatatacacgcagccaataaacatgaaaaatgcgtcacatcactcatcatcagagaaatgcaaatcaaaaccgcaaggagataccatctcacacccgtcagactggctttgttaaaaagtcaaaagacacccaatgctggcaaggccgcagagacaaggggatgcttatacactgttgttgggaatgttaattagttcagccactgtagaaagcagtttggacatttctcaaagaacttaaaatagaactatcatttgacccatcaatcccattactgagtagatatccaaaagaaaacaaatggttctaccaaaaagacacatgcactcacatgtttgtcacagcactatgcacaatagcaaagtaatgggatcaacataggtgtccgtcaacgttggattggataaagtaaatgttgtacacatacaccataaaatactatacagccacgaaaagaagaaaatcatatcctttgcagcaacatagatgcagctagaggccattatcctaagcaaattaacataagaacagaaaaccaaatactatatgtactcagttatgagttggagctaaatgttaggtacttatagaattgaagatggcaacagtagaaactagggactaatagaaggggaaaggaaagggggagacaagggttgaaaagctgcctattgtgtactatgcttactacctggttaatgggatcatttgtatcccaaacctcagcatcacgccatatatccaggtaacaaacctgaacatgtaccctctggatcttaaaagttgaaaaaaaaagatgtcatataaatattcgtggtcactaaaagtatctaatgtattatacataaaaataaaaattgggtgaattggaagtgtattctttgtatcaagtcatgtcggagatcctattctgctttgatcacagtgtgaattcttttgcatttttgttaccagtcacttctttatttattgaactaataattacatattctgataatctgtcagaaagataaaaacattctttgtccatgtgtctgaaaatttttaacctatttttctaatgttttaagtgagaagagcatgttaatactgaaattgtaagcagtagactgaaaaatcatcccaatccatgggttatatattgaattgcttttaactgtattactaaatattaagcttaatttattttatttctacatatccccatttccactataggtgatttgtatgaatttaggaacttccttctctcatccatttttatattaaaactcagactttctaaaacaatatttctatccatccatcgttggtaactatgtactgacatgttttgtgcatccgaaaaatgttagcattagtttgtgcgcacagaagtaattccagtcaccatatgatgagctgatttatttatttcgtaagtgtgttcattattattatctcttcagcacccaaatatataggggacttaatgatacctacaagtaaaaacggaagacaaaaacgccctgctctctacagaggttaaaatgtttttgcaacagggctctagatctcagctgtgaaagtagggacgagatgaggctaggcatgcagtgtcagtataatacaatataatcaacatgtcagcatctaatgcaggtgttgcaaaacaaaatgtacacatgggtagtcaggtaacagaaaagcatgaagtagtaagggctatctatgcaagaggttccaagctgactatatactgaaatatttaaacactatgtggggcaaataaaatggacattagaacagttcgatggtcagttggggacttctgctctttcttccagtctctgaacatatcttaaagccacaatcatctatttttatttattgttatacatttatttataagccagcacccctgtgatttaagttctgttgaaatgctgagttggaaaagatcgatggatgggggaaatttagtgcagaggttttgccccaggttcaaaatcctttataaaatattaatacatggaacaaatattgaacaattaaaccactgataagttaatcaatctgattcaaagtacacctgtgaagagggacatggcaagaaaaatattacagtaagaactagaaacattccttcatggctgcttgatatggatatgtcatgtttaagaaaattcttctttagactgttgagattttttttcctgacaaagaagattcactgtcgaggaaagaaagaggtactgtgaaatttgttattgaaaacatgcacatacttttgtcagaatgagttaaagagtgaacaaaatgtgcctattacttacgtgttgtgctgttttaattcaagattaaaatatttaacgtccacagacaagaccacttttatatgaatattatttttctgctttattgctcaattttattaccatttcaaaacacccgtgttgctttctatggccaaagatgtttagcacttttcatggttatacttctgtacagtccaaaatacaacacttactttacacatacacaaacatccaatgtattttgttttctgtcaagtaaagacaatgtctgtgttattaagttaaatgtcactttcaaatacaggatatgttgatattagaatgttcaactttatttcctcatttaagcaaattacagtgtgaagaatgtaactgcagcaatttataaaaatcatatcacattcaattatgagagcaaacttgttttgtagacttgaactagtttcaattaatcttggagttatcatttcaaaaattctaaacagagagaaatacggagtgtaataatggtaggtctttgggtaagctgcttccaggaaaagaaagcaattatatatgttcacatagcactgacaaggagaaacaaaactttggacggcaaagaacttgcattagtctttttgacatgttcctgtggtgtgatttattacgtagacaatcagctcaacttctcaagtttgatatccttggaatcatttgaaatttaaattttaatgaaaattcattaattccaaggccaaaagaagtgattctaattgcttttgagaatcagactatgaaagaattctttggcaaacttgcactgtcttttctcttttatcattggttgcttcgtaggtacttaattgaaggtcctctgattatcagcacgggctgacatcagttcactccatgcattttaaacagtaggccagatgtttaaaggatcagctgaagcatcgatagcatgctagggtgaataataaaattttcattatctacaagaagcaaataaaaagcataagcattttcccccattatcctgaaggagaagatgaatgcctaagcaacattttaagaatgggttgagtgtggcctgtgggaaaatttgggtagaaaacttgtagttagctaatgtatatactgtttgcctctttagctcaccatatacccacacacatgggcatgcatgcatacagacagacacatacaatacacacaacaaacaggaaattcagatatactgaagaaatgtatttaagggattactaagtttttgtaaataaaatcctttaagatgctgagaaacaatggaagagaagtaggacatgatggctcatactttcgtaatttacttgtttaacgtttgccaaggtttaaattaatgtagatgtttttgtggctaggattaatgatctaacagtttggaataattaggcacttttatcacctagaaagcccagaaacccagcatgcaaaaattctggtatgtctgcattttacacttagatataacagagaaatgacaagtagtcaagtggatagagaaacgaatgattcttcacacatgcacacacacatagaaattgtctttttaatagtattttaatgtaacacatttatgcataatttctccatagtgtttatcttatagtgaatatgtgatgaatagtctctaacattagtggttttatagattaaacataattaaggctttatatattaaagagtcaattggtgacattctaatataaacatgtttatctcatatacattgaaatattagataattcattcgttgagaataaatcgaatgagtcaaaacttttaacctccactttgagctttgtaatagtatccactgaaaatattcatgaaaatttttaagtcatttctatttatatattcagtccaaacatctcacaagtttaaaatgtaaactcaagaatataatttctgtattctacaattggaagcatccatcatatcagatgaacttatatagtttgtgaaattttgcaaactttctgtttagtaaatcttaatgtcaaacattttaacttccaggttgtctttcttttcagttttaatatccgcgatctttgtatactcgttgaatggattctcaataagtaacccacaaatatatatacatactatgtacctacaaaaaataataaaaagtaaagaaatcgacacttatccatacctgtcccatagtaataaactattcataagtatatttgaaagatatgagaatcataaaagttcgtgtttgcacccttttgtgcgtggaatcctaggtttgcattttgtggatctagactttttggagtgtggaaataaatgaaacaaataatcgagacccagtcttatattcaggttatcattttactacataaagcataaataacatttgcagtttgtttctatggctagctctaaagtcttagcaacgagaacattatagaaagacttcaactgtagcttccagcagaacttctgaggttccgtttatggactaagcagcagttgagggggacaaaactcataggcaattgatcactccaaaggatagattgtcttttctaacctaatcaaaagatttatagtgaaggcatattcagattttgttgaaggatatggatatataatcatgtgtgtgtgtgtgtgtgtgtgtgtgttagacatacttaaaacattatttgagtagaaaattctgcacaaatggaaaagtataacatgtgttatatccacacatgttgagcatttacctggctgaaacatcaaaagctgaattgacttaattgaatgttgaatacttaatagttactttgtagtgactcactattaaaacattatctcaagctttgtcagaattaatttttttaaaaaactcagattagtgtcaggtttactgaaacagcagatctgaaattactgtgtttttttttcctttcaataatcagtttctaatccaaaattgaatatcagttccaactctacattcagtttctgttttacttgtttggactggcttttggttctgttttccacatagatcctctctgtgtaagacaaagccatttgtgcagattaaattttactgagcgtgttaacctatttaaaacattcatccaaaaagactagtatgaattcttcatatggcaagctgcttgttttaaaacttccatttattctaaaatcctttttacttatactttttaagaaacgtattcccgatatacaaaagtaacacatgctcattaaaacaaattaaaaatagtattgtataaagagctgatacatttctgccttgccccatttaactttcttaagtgttcatgtgaatcatccattcacatcaagacatttatctgtattcatatgaacgtgttttaatatatataacatatatagaattttatataaactttccttttaaaatagaaatgaaattatatgatatatttattctgtgtctagctcttgtcacgtaattattcaagaacatatttctaggttaatatctgtattcttaggtagcattcactaactcctcatctacttgttttcttccattctaattgtgtttaacatttcttcatacaattggttgtcatttggtcttctttcatggagggtgcataatgttcattctcaccaattctttacactttacataactgcttgatacgaagccagaccttataaatatcaacaaagcaggaacactgtaatcagctatcagtttcagttgagctgaatgaccctgaatatgtgtacacatattttccaggagattttaaaactgacacctcagatttctaagacctggagaaatcagcatgagaaacattgatctatattattccgtgaaatgatttcactaaatagtgaagcatctcccacatgtggactctgtaatttattagaataaagagttcatgtgcttctgaagaacttgaactactcttctggcctccgtacattggtttcttagctataggaaggctgagcatgtttttcctatgcgtttcctttctagctcatcattttagtgacaaaacaatctttcgtggtgttgctctagctatagaattgtttcagattcatttgaccaaaggtggcaaatacaacagtcccaacaaaaacaaaagacctattacagaatgatggaaatgaccccagggaacaatggcacctccacatttcttaattccaaggttataagcagtggtgtggacaattctcaattccaatgctgaatcgccttctaatttcaaatacctgtgctaaaaattatttacgtctactgaaataatgaactggaccccaccaggaatggccgatatgcttgtagtcagagcacaactgtagaaagaaaataacattttaatttatagaggtatgatgatagctgtttcatactgttttcagaacgatgaatggcctgctcagtagtttcttgtcatcgtactgagacactttaatttcttaccagctgagatgaggaatacgagcccagtgtgcaggtgaaattggttaacaggagccattaaaatttggaagagtcagaatagcatcaatcaaaatgctttcagtgtaggaagtaaacatgtactagcctgacccacctgtcttttcttttaggtatgttggtaatattacaatcattttgaggtatccataaacaactgcttagatctgaagaattgtatatctttctttactctgccctggcctggggttatggttctcattgagctctaacctttcagaaaaaaaatgtagagaagtggttcaagaagaatgctttatcttgcttcataaaaatgatagtgatagttttattgaaggcttactatgtgccaggccaaagtgcgttttattatcgttcccattttccaggcaaagaagctggagcacagagaggctaagtgagttgtccaggatggctcagctaacatgctgcagttgggatttgcacccagaccaacttcttttcaaccactgtcccatcctgtgtcttctctactcaaaaagtgtttcagctccaaacctgaaactttaaagaaaaggaaatccttagtggaaagactaggttttagtcacaaattatctccttccttacattatttgtctctttttcaaatactccaagctttgattaaaactgtctatcactaggaacattgtagaattgctaaggtggaattgttaaaagaactcaattccaattaactttgccattgattactgtgtgttctggaggggtgttctttctttcaggttaatgatgctttattgtatatctcaaagattaaaaataacaatgaaggaagtagcaaaccggaacttctctcacaatgcatctttcaatctcgtgctttaaatgaagataaaatcatggctgtggtaaggttgcaggaaggatgatatagattaagtttcttgcaaactgccctctgaattttcaatagctgtagaaggtattggttttccaaaaaattgacaaattgaggattcattcagcagtttttttctaggtctcttaccagaaagtgatcactaaaaagtgtagggaaaccactcaaagttggatagatcattattttcacttaagcattttaatttcttgaaggagctttataatgcaacaaagaatttacagtcctgtgtcaccgcttaaattttctagggtcatcagtaaactcagtggaaataaattagttcatgaatataattgacccttaaattctgtcactgtgcaagtaatcggtgggtctgctggatatggctttcgagcagacaggtcaacttcttcaaacagagaagaagcatagcataaattgaagacaaataacaaactacttgtttcctccttctttggcatcaccctatggatggagtatgcatttataatttaacacaatcaagagatctttattatcctacttttgggtacaactgcttcgtttctcttttgaatctctacagctatttaaaaatctgttttgtaaaattctttaaaaaactaaaacatcagattcatatttcaggtatcttactatcttataccaacttaagcatccagtattatcacccacccttcccctgagtgaatccttagcactgggctcttcctgttttatccctgtgcatgctgagctctttctggccttcaagtctacttccgttgcaactgttgtctgaatggtctctctatgtccttcttactctctaaatatttcggaatttaaagcctggaataatctaccttagtccaaaagatatgctacactattctagttcacaatgatctcacactgccgttgatacacaacatttaatatcaacttaatatctatttcagttcattacgaggtcacttatgctacatcttatattgttgccttggacttttattatctcttcatatatgtgtttatggtgctcccaccctcacgagaagttgcaaataccatgttagctgtctgatggctttctatgttgtcaggtataccatttcccaaccagttggcattcaatgattaagttcattaacaaagaattgtatgtgttgaaaaagatgtttttttcttaatgaagcacttgtttttatttttttaatgaaatccaccctcttaataaattttaagtgcacaatacagtattgttaaatataagcaaaatgttgcatagcagatctttataatttttttaaccctacatgcctgatagtctatacccattgcacagcatctcaccatttcttccctcctccagcccttagcaaccaccattgtactttctgtttctataattttgactactttagatacctcatgtaagtggatgcgtgcagtatttgtccttttacgacttgcttattttatttagcaaaatggctacaagattcatccacattgtagcatatggtaagatttcctttttgtggcagaatgatattccattgtatgtatataacatagctttatacattcccctgtcaatagacatttagtttgttcacacctcttggctactgtaaaaatgctacaataaacatgggaatgcagatatctcttcaagatcctaaattgaattcgtttagataaatatccagatgcgggattgctagatcttatggtagttatattttttatttttttgaggaaactccatattgttttccacaaaagctgcacaattttatatttccaccagcagtctacatctccaattttcctacaccttcaccaacacatgtaatgatcttgggctttttttttttttttttttaataatggttatcctaatccgtgaggtagtatatcattgtggatttgatttgcatttccctggtagttagtgatgttgaacatcttttcatataactgttggtcattttaatgtcttctttggagaaatatctattcaattcctttgttcactttaaaaattgggttgttcgaatttttgttgttgttgttattacgttcctcatgtattttagatattgacaccttatcagatatatggtttgcaaaccttttctctcattctataggttgcttttaattctgttgattgtttcccttgctttgtagaagctttttagtttgatatatttctgcttatctagttttgtttttgttggctgtccttttagcgtcatatccaaaaaaaattattgtgaagaccaatgtcaggaaatttttcccttatgttttcttctatgagtttcatagtttcagatcttatttttaagtctttactccatttcattttgagttgatttttatgtatagtttaagttaaaggtccaattccattctttgcaatgtgtatatccagttttcccagcaccattggttgaagaggatatcctttcccagttgtgtattcttggcacccctattgaaggtgatgctaggtttatttctgggatctctattctgttccattggtctatatgtctgcctttatgacactatcgtgcgctcttgactgaggtagctttggtaattcattttgaaactagcaagtgtgatgcctccagtttattcttcttcctcaagactgttttggctatttggagtcgtttgtggtttcatatgaattttaggaaatttaccttatttctgtaaaaaatgcgattgggattatgataggaattacactgtatctgtagatggtttggatatatagacttttaaatgacacatcagatgtatttccatttatttttgtcatcttcaatttctttcaacaatatttcatagctttcagcacacacatcttttaccttcttggttgggtatttactaagttatttattctttttattgctattgtaaatgagattgttttctaaatttcctgtttttatgttgctagcgtatagaaacgcaactgttgaatgatgactttgtatcctgcaactttgctgaatttgtttattggttctaaccatgtctctgtgtggcgtcactcttaagattttctacgtatcagatcatctaatttgcaaacagatataattttacatcttcctttccaaatttgatgtattttatttctctttcttatctaattgttctggctagtacttctggtacgattttgaaaagaagtggcaaaagtgtgcattcttgtcttgtttctgatcttaagggaaaagattttcagtcttttgccattaaatgtgatattcactgtgggtttttcatatacggtttttattatgttgcggtaatttcgttctattcctagtttgttgtgtgtttttatcatgaaagtgttgaaacttgttaagcgctttttctgcagctattgagatgaccatagatttttagcctttgttctgttaatgttgtgtatcacactgattagttttcataaattgaaccatttttgcattccaagaataaatcctatatggctctcgtgtataatcctttcaatatactgttgagttcagtttgctagtattttaatgagttattttgcttctatatttatcagcggtattgttctgtacttttctcctagtgtcttttattgactttgatatcaggatactgatgccccttgtagaatgagcttggaagtgttctcttctctttaatttttctgaagaatttgagaaggattggtgttaattcttctttaactgttcattagatttcaccagtgatgacatttggtcctgggcttttctttgttggaaggttttggactactgattcaatctccttactagtttcggcctactcagattttctatttcttcaagattcaatattggtagattgcatgtttcaaggaatttgttcatttttttctaggttaacatacagttgtttacagcagtgtcttataatcatttgcattctttttggataccagttgtaatgtctcctctttcatttctgattttacttatttgaattttcctttttttttttttttttttacttaatctacctaaagatttgtcaattttattgatttgtttttaaaaaaactcttagctttgttgatttttctattgttttctatttcaattttggcttttttctgatctaatcttaatatttccttccctctgctaactttgggcttagtttgtccttctttttctaagtctttgaggaagaaaatggcaaggacatgactttctttagcagttggaaggacaatgctgtaaatactcaaaaattaattatttttatagtgacaaaaacaaaataaaaaacacttcaaagcaaatgaaagtttatcatttaatttatcaaatcactaagcagactgcttgatcagagagaagatactcatatgatcacataaaactgaaagattaagaggtaaggacattcatgttatcattacatctaactttcttatttccaagatggagaaactgagggttggagaaaaagaaagatttctttgttagatacaaacagacaggactaaactcagtatagcagcctcctaaattccaaagtatcatgatactgtgattttatgcattcttcagaaaaatagtagagccactggattctggcaaagaagttatataaaatgtcaagttcttcctttgcctcagaaatgaagttttatgttccaaaattgattgggaagttctccttatacctcacatcacgtctactattttacattgtttacttttgaagaatttttttaattgacaaataataattgtacatattcatggagaacctagtgatgtttttatatatgtaatgtatagtgatcagatcagggtaattagcatatccattatctcaaacattggtcatttatttgtgttgggaacattcaacgttctccttctagccatttgaaacttctatattattgctaactatagtcaccattcagtcgtatagagcactagaacttatttctcctatctagctataatttatttttaaatatgctttttgaatctgttactataaattgaatgtcacatcgttttgaaaatattcttaatttatgctcaacaggcaagattacacacctgtgataatatctttaatttaaaacattactctgtttaatttaccagaatatggaaccctagtcattttagaggtggagcaaatttcagtgataatctagtgcaaatttctcatcttatgaatgaggagattgagtctgatataagggacgagattttcgtcaatgagcagcttgttaacattagctctgtgatagaacacaggcacttgtcctcccaggccggtgtttcttctactctatgatgggctgttttgttgtagtttttaaacagcagcattttcaccatgcatagttttcttccaaagttcgttcttaacgtttttgcacagaataactagattttggaagtagaaaaaggaaattctctttgcatccttgtatctctggttattttctttgtcctttgatctctctctcctcccctcccctcccctcccctccccttcccttccctcccctctccttcccttcccttcccttccctcccctctctcacacattagagaaagagttaaggtattaaagaatacataatactattaaatttccttcacatagagaaaggaatgaaaaaaagtgaaaaatggtcctcaccaaatgtccaaacttctgtaggtcatttccatagtatcagcaatgtcctgtatggtgcctcggggatatgtaagcaaatgagcaagtggttagctaattctagctttggcaaacacttgttatggcttacttgaggagaagtcacttctccaaagtgaaaataatgtgcacaggtcaattagaatttttttgtagaaaaggaaaatactttgtagggacatggatgaatctggaaaccatcgttctcagcaaactattgcaaggacaaaaaaccaaacaccgcatgttctcactcataggtgggaattgaacaatgagaacacatggacacaggaaggggaacatcacacaccggggcctgttgtggggtggggggagggtggagggatagcattaggagatatacttaatgctaaatgaccagttaatgggtgcaggacaccaacatggcacatgtatacatatgtaacaaacctgcacgttgtgcacatgtaccctaaaacttaaagtataataaaaaaaaaaaagaagaaaatacctccttatgctcctgacttattttctttttggttcctcagtcctcttctctctctctctctctctctctctctctctctctctctctctctctcacacacacacacacacataccccacatatacaatatgattaaggatatatgtgaataatgaaagcttcttgtgtatagatttagaagtctaatggacaaaatcaatattttcctatgtgcatttaattcccccctttgatttaggtatatagtctttttttaaaaaagagaaaaaaaattaggtgaccttaaggtatagatcctactttcaaaaggtttacagaactagggagaggaacatggacaagatttaaagaactattttaagcagaataaaatgtgatttatgaacaaagcatatattatttgtgcgtatgtgtgtgtgccaacaaagatgcaattaggagattgcacagggagatgtcattagaaccaaccttaacgggtgagaagtctttgaagacatttagaacatggaagatctctgacagagggaacaaaggcatagtgacaaaagtcaagggcatatttaggactggagagtggtatgtgtggcttgagagtgggcgagaaaaaacaacaatgcctctgtaataggaaagtagacagaggcatgacattaagagctttgccagctgtgctaaaagtagtgaacaagagctaacaaagtgaagaaatgtaccttttctgatgtgtatcattcccttattcatatacttcttgagggggaaattcattctgtgttgatctagtaaactactacaggaccaaatgataaaaagaagtataggaaagaatgtttcagcatactttacgagataacttccttgtagctattctccatagtattttgagcatcacaaagcaatgagctgaaactgtctaagccaaaattgacttgtcatctgttagggatgcttagatgagaattctacatttgagagcttcttagattcattgaccactatgtcccattctaagatccatgaatgcgtgacctaactattacaccttcttttagtctgattgtcaattttgtattttcaattgtgcaagtttctaaaactattttaggaagataaatctagcagtggtgtgggaatagacaagagagaaggggaaagactcttcaggaaactaaactcacaatttatgagtattctttattgcccaagtcttcccaaagtctttcatcaagaaagaggcattgcaactctccttttatagtttgtttttattctggagcagtgatgttttggtggagttgttcctcagtgcgtaattaaagggcctatgacaattacagttcatctcctgctgctcaaggtactgcagatatttggatctactactctcattcatttccaattaatgtcagctttagatttccttcagtatgctatgttataaaatttgattatcgttgtgcccaccttcccacttaatttcaagcaggtttctcgattacctgactaaactaatgaaatctgactaacccaatatctgtggacagtagtgtgatgttactgatttttgtatgattagtcaagtcatattcatgccacgttttcatatagtaccataaaggatattcttctcgtggtccttttcttttattctgaacatacaatgagaagaccggtaaagtgggctaggaaattaaagaaaaatacaaatggcaaaaaatatgggtcactcgaagtctagaatagagagcacaatcaattttgaattaaggggtgataaggtgatttggtcaggtgactggtgaaacaggaaagaaactatactttttgaagtgtttcatccatgtgttaagattcatttggggtcaagaatctaaatttcatatccctgggagtggaaactaagtaaaaaaaaaaattatggaccttggtttaatagctagaggagcaagagtgtatctttatgtgacttaacttctatgtgaaaagtgaaccttaagattaattattgggggaatttacttactcaggttctatgcctagatggtctgcccaactaagaaaacttattttcctgttactccatcctatttttcatacttttatactgcacttgcagaaaagcatatatttctacccaatacgaaaattcctgggaacatatttttctacatttcccaaattacttcaaaaagtaaacttaggttatttcatgatctccattacaatggacaggtggccttattgaatgttgtcctgtgaatacaaagatccagagtttaaagaacaaggtgtacttgcatctcccacttagggtttgcttgtggtggagagagaatctagtttgcttaaaaggatgacagtgcagtgccccaaaatatctgatatcattaaaagtctcatatttgtctttcgtaacttctctagggctgtcgatgacaggagacccttaactcctatgccttgattatgtgaataagcacatgaaaatattttagttatcttagttcacttttaaactaagtttcaattatcactagattctaaatatcatcattgagccgttcttaaggaactgattttctacatattcattcacttcacctatatctagtgtgtctactatttgccaagaaaaatttactctcttaattcagcattccatatacttaacatcataaaaagtaggccatttttagttttctaaattatttatttaaacatttctttaaaattacattctatcattacactatatttcaacactacagtaagcagcctattttgtgatttttccttatataaaatacataattgaaattaaaaatgaagttaccaagagccattttcactctggggaatgcacatttataaattatggggttattttttcttcatcagctttcatattattaaactttgtctcttcataattacagagatgactagacacagaagggaatttaacatttggtgtgcatttgtctaacctatactttatgttagaaaatacatttccatttgaaaaaaaatcagtaattgtgggtgtgatcaagagggcagcctgaaagtcgggtgatgtgactcacacctgtaatcccagcatttttggaggccaaggtgggattatcgattgagcccaggagttcaaaaccagcctgggcaacacagtgagagcctgtctctattagggggaaaaaaaaaaaaagaggaagttagcctgaggcaatgtaaatgaaatacatatttcaaggatatttatacatgattcacgttattcatataaagatgtgccagagaagactataggtacgttattttacactattttgctaggattttaagaaattcaatgtgtttttatttcagttaacttagaaaacttacctaacttatacttctcatggacacaaaagtttttaaagataggatcaaaaagcccacatggtgaagcattttgaactggatgaaaaacatctattatctttaaaattttatgatattactgattgtaatagactccctttttaagaaatcattccttatagaacataaggtttacatttacaatcaacaatttctatccttactacaataaaggcacatataaaaagtacagttgcatatttagcaggtttaattgtacattttaatgtagaaatcaattcaattctttcatttatcagcattattacagtgatttcaaattaagcataggtaactttgatatagataaatgatgtacacagcagttaaattttattttcaattatgtagtaattgtataacctaggcagtataatttgtaaactttgtattttattattatgcttctcccacttggcataagcacaacacttcctaaaagcataattttctatagacttaataactccctaaaaacctgttttggacccctatactatttgatataggcagaaaaaaaacataatccatgctcaaatttgaaaaatgactggtcacatttggtataatactaaaggtaaataaaatcaagagtctatgaacatttccggacctgcacatttgttttattaaaatgcataattgtctttagtgtgtttctatttgtttatactctactgattttaattaaaaataccaaaatacgtttattaaaaaactgtcagaatctaagttgttaaatatacttaactaggaaagtaactgtttaaacgagataatttatagagaaatgtggtgtattgccaattagatgtcaagatacaatacaactgataatgaaaaagtagcattttcttagggatggaatacagtgtaaggaacaccccagtaagaatacaaaaattactgaaaaaaaatcttccttcctgaaaaaccaagtgcccttcaagtgcagaacctcatccaactaattgttaggtatcactaaagcctgataccttcaattttctggatcattcaagctgtatttttgagtccttatactagaggaggtaaagagctataaaaacacttaatggtatctgatgtgaactgtggatcactttgacccatcacttctacgtctacatcttggataaattcccattgttgtcatagattgtacaggtttaatggtgcgtttgtggagggggctcgcttatagaaaatggagactctgaagggataaggaataaatgtatcacttcaggtcttttatttgaaattggggtccagagagcctttttgtatcagacttgtcaaaccatttccatttagtaattatatatgcactagcacttattcctacttacctcacctctttatgcccatttccttgtagttgcggttatgcatgaataatttattgcaccccttaccaacaatggaataaaacttccattctgaaagctttccatactcatttccaatagcaatagggtttttttaacggacgtattacaaatgtacgagtcagttgaacatagtattcctctttgtaagaactccaagtggatgcatgctgttgtctcaaatctcaattagaccttgctttgaggtcccttcattgccagtcatctgttctccttcccctgacttgagtatttctccagatatagataatacattttcccaactctgtgttccaagaactgacagtggctttcattcattttgtttgtttgtttgtttcttctcgttctcaagtatcccgcagtctactgtttcttccctccattcgtttgtcctttcagagtttcaaaatccagcataggtacttcttctaaaatgtcttacccttcacatacacacaccacttgagaccccatcagcctctgtccacacagtttggttacattcatagactatttttatacatcaaaatatttgaaaattttagggtaaatctcagtagtcattcatttttgctcttattcaaccaatactagtcaatcagcctgtgccaggttttgttgcaggtaccaggtatccatccataaagaaaacaacgtccctttgttgtggaatttacattttagcaggggaggcaaagaacccaataaatatgataaaatatcagattaaaagtacgatgaaaaaaatcatcagggtaaaggaaaaagggaagcagtattttagcaagagtggtgaagagaggaggctgagagtgtgacatctgagcagagacctaaatcaagtcaaggaatgaaacatgctactatctaaagaaatgagtcaggataaggaactagtaagagccgaggcccagagatgtgaatatgctgttccaggaacagcaaagagactggttgatatgatgtgaaaaatgagaagaaaccttatgatatgtgtcaagagaaaaaaaaaatttaaaagcatgcttgggaacggaggcctccagatgaaaaaaaaaaacacagttcaaatccttgttcatgcatttagtttgctttgcaatcttgggcaaaatgttaaatttctgtacgttttatcttcctcatttttaaaataggcacaaggacatctacttaataggttcattgtgaggagtaaatgagatgatatatctaggatgcctggcattatatcatacacttaataatacactgaataaataatagttatgtctatttatttccttatcgtttttattattatttcaatgcacagacctgttcataagataatgataaatattagtggcagaaactgaagatgttataaattattaggaggcgggaccactcagttcaatgtatctgttttaatatagtcagcaaaagtgtgaagataccaacaattaaatttcaatgcattcttccatttcactagttttataaactgatgaactaccagaatgtcaatgtatgaattgcatactcattcttaacaaacagatttgcaaaattatgtgtaaaattagccctcagccttccaatttgttattgtcatatttcatggaaatacataatctgtaaatttttgttttaatgatatgtgaaactgcctaaagtagagtcttggcaactacttcacatttgtcctccagagatagtggataaaagtgtcaataaatgaacactctatattcactaatcacaggcaagggacaaggaacagagtggtcacaaaataccacaaaattaaagcacattccaaattaaatatatatgtttttattacagataatgtttgctagactctttctaattatctgcaaagattttaggaatgttttaatgttttaatatttacacacctgtgtatttcaagttcagtcaaacactattgttaaaactaaatcttctcatctctaataataagatgtgaacttatcttggaaggtggttattaggatgggagagataatgtatttcattcaaagtaaaaatatttctctgtttctatctttctctttctctgtcatctatttatcatctatatccaggtatctatgcacctatgtagactagcattcaatgaaccatagatattattagtagtagaattgttactaatattaaaataagaagtatttaagaagaaacatgtcctaaagcataaggtcaattattactctcatgttttttggcatatgaagcctaaaaagtgtcaatttcaagagagtattaataaagattgtgataactgaaaggttcctgcttgaaattttgtgtggtcttacaaatatataaactctaagcatttcagtgagccaattactgactaggcactatgtcttatgactcttttgtcatagtatgtaaaaaacaaagagtagagacatcataaaaattatagtagatgggcactagggaattacgcaaaataatttgtagatttaatgtgaaaccaaaacatctgttcaagtcaatttcccacaggtcatgtggcaaagagtatgagttccagactgaggagaggaaaaggttgttcttccacagggaaataaactgagtgtaataaacataatttttcttcttaagcattatttaaaacaaaaaaaatgccattaaatctatctttcctgcctctcttatcaatgctcccttccctttcaccacttgtttcaaactccaagccttgggattttattttggctttttgccttaatgtaactaaaatgagagcatcacaaatatgaagctcatcaaataatttagcagcattttcccctgtttttaactttctctttggaaacgtagatttcgaaatttaagggcccaaaatatgaaatgcaattataataggccatttgttcattcagcttgataaacttgaataaatagtattgaacttttaatgcaaaaagaacaaaacaaaatagaactctccacgaagaaacttttcaatgtttgcatttctgtgtgaggagaagggtaatgaatgtgggaaccttaatggaatccatgttcttccagtgatgacaagggtcaaaatggagaaaaatggtcactttctacccagtacattatattagttctatgtggacaactataacatagctgatgctggttttcaggccataaatgtaggtatgtattttcctactatttataaggcaaaatttctatttgtttaatgatttctatataggtagattattctgtctttaggattaaaaacgacctgtagaccaagagactttctaatgtccaccttagagtatatggcttttactgttacagtttccatttcctttgcttgcccctttgagagaaggaaaggagacatttgggatacatacatcaatgaggagctattaatgaataaatgaatgaaattgtcagtcaatttatccacatgatcatcaattgccaataattttatcacctctgtgggattaagtagaggtaacagtttagaaatttgattttttgaaagcatttaaaatgttcaaatatatcactctggtaactaagggaaagtgtattattttcttatgcttagtcttattttggttttgcctttttaatttaaattgaacacttatatcaaagagcttgcaggattataatttgaatttttgaagcaaagatcattttcttaacatcaaacaaagagtagatacaataggaataaaatcggcagaaaaacaagagtatcaaggacagacggggagggtgggtctgtgttagcatgtattgctatgaagaaatagccgagactgggtaatgtatttttaaaaagagctttaatcgattcatgattctgcaggttgtacaggaagcaggacaccagcatctactcagcttctggggaggcctccgggagcttttactcatagtggaagatgaaacaggagtaagcatgtcacatggccagagcagaagccagggggaggttgccacacatttaaaaaaaaaaaaaacaaaacagatcgctcaagaactcagctgctatcatgaggacagcatcaagctgtgagggatccacctccgtgactcaaacatctcacaccaggccccaagtccaacacttggcattatatttcaacaagaaaaaaagtttaattggctgatggttctgcaggctgtacaggaagtgtggcacaggcatttgcttggctcctggggaggcctcagggagtttttgctcatggcagaaggtgatgcccacacactttaaaaaaaaaccagatctcatgaaaactcactcactacactgaggacaatacaaaaccatgagggatctgtccccatgacccaaaaacctcccgccaggccccaccaccaacattgggaattatatttccacttgagatttgagtggcggcaaatatccaaactatatcagggctcatgtccagttatatgtcaacatgcctgcattcgaaacatcctgtccaaatcactgccttgtcataatacttatatttttctttattgaatacgaacacaagaagattaaataatagcatttctactttaaaacagtgggcaccatattaacattggaataatagtagtaataacgatagtaataacaatgatataggctgggtgcggaggctcacgcctgtaatcccagcactttgggaggccaaggcgggcggatcatgatgtcaggagatcgagaccatcctggctaacacagtgaaaccccgtctctactaaaaatacaaaaaaattagctgggcatggtggcaggcacctgtagtctcagctacttgggaggctgaggcaggagaatggcgtgaacctgggatgcagagcttgcagtgagccgagatcgtgccactgcactccaacctgggcgacagagcgagacttcatctcaaaaaaaaaattaaataaataaataaataaataataacgataaaaggatatgtgtaggttttttttttaataggctgttaacattaataggcattgtgatttcagggatatcatcaaacatcctggtcctaagacatcccctattgaataggaagggcttaagttaaacttctcatgagccacaattttctgattatatgtttggtgtgtgtaatagccacctcagtgatgatttgattagcctggacccttacataatcattgaagtatacccatgttcctttatatacttctttagtgttgaaagctcaaaattaagcaaaatagtccccttgataatgtttagattcttaacatttgctttctaaagctggcaaatactctcttcccagtgtcatgaagttaaataacatgttgcttagtgaggactttaatgttgccatgccataggaagaccttattcgaaatccccttacctgggagaatgtcagattattaccccccaacttgtttaacacttttaggattttaaaggtgttcacatttgtattagaacaaaatactattgagaaacatttctagaaaaaaattatctttccaaattaaaatcagtggtatgtaatgtaggagtctgattataatgattaaaatacatgggctttgggcatactgcctaggtgaaactcctggtttattgcatcactattagtataacctatgggagttaacctacgtaagcctcagttaatttttctctcaaattgatctaataatcgtctctcataggcttgttttgatagatatttcagtgtatataatatacttaggacagtgcctgatatcagtaagtctccttatatgctatttttctttctattttaattatttatgcaagagaaactattatgctttaactcaattaaaataaaatgcctttgtatttattcatgtcaaaggaaatatgcaagtattgcattcacttcctaggtgcctttttgaattgagctttgcatggttagtttgtataaaaggttcagtgaactttctcataatgattttttattgaacatatggaatccattaagtgttagcaaaagtcactatccactgagctgtgtccaggggctgacagttatgtctatctcttgcaaaaataaacacatacataaatgcactaagacgtatattacctgtcgtcatctcttagagcatttccatttttcttttaagttttttctttcaatgggttttttatctttgtgagtacatggtaggtgtatatgtcaacggggtacatgaggaaggtgtatatattgatggggtacaagagaggttttaacacaagcattcaatatgaaatagtcacatcatggagaatgggttatctatcccttcaagcatttgtgctttgtattacaaacattctaattatactctgttagttattttaaaatgtaccattaagttattactgactatagcaaccctattgtgctatgaaacagtagatcttattcttatttttctaacatcttagaacatttccacaaacactacctgcttgttaaatatacctattctaatcttcatataatcaattacttttttcctctagaatgtactatgacacatccatggggaaaatgtagtaatctaattaagactatttcctctcattttatatttaaaagaatgtgctctatcaatttatttacttgtacagccgtaggcaacctctaaaatatttaaagttcttaaaagtcagatatttcagttaatattgtgattatatagttgattttgatgaacatgttcatctaccagaaataaattatacacacacattgatatggttaggctttctgtccccactcaaatctcattttgaattataatccccgtgtgtcaagggagagaccaggtggaggcaattggatcttgagggtggttttgcccatgctgttctcctgatagtgaatcatgagatcagatggttttataaagggctcttcccccttccctcctcactcattctccttcttgccaccttgtaaaggaggtgccttgctttctactatgccctttctactatgcccttcaccttctactatgattgtaagtttcctgaggtctccccagccatgctgaactatgagtcaattaaatccctttcctttataaattacccagtctcaggcagttctttattgcacatatatgtgtgtgtatgtgtatgtgtgtgtgtgtgtatatgtatgtatatatgtatacatatgtgtgtatatgtatgtatatatgtatgtatatatgtatacatatgtgtgtatatgtatgtatatatgtatacatatgtgtgtgtgtatatatgtgtacatatatatatatatatatatatatatatatatatatatatgaacagagagagagagagagagggaggaagggagagagggagggaagcatggagaaagagagagtaatagcctaaatagaaataaaactagctccaagtacaggttcgtcaacactctcctatcatacccccaccaaagttaatgttaaccacttggagccctgttcttccttagttgtggagtactttagcaaaattttaaatctaattatgcctaattcaacgacagtgctaatttgaaagtgttagaaactgaagacctataataataatgagagttacaaaacataaatagtgagacaatgatgaatgtagtggatgcatgtacgagggctatcatttgacagtagagatgatgctcaaggacagacaatgagtctttcaatgtgtggagaatgtgctgctgttacagtgatgtacaggaaagaaacaaaaactgaggaagtatcagtaaacaaaacactcaaacatatgagtatacagctagaataaaagcaacagtactagatgacaataagcccaatgttaactcagaaagcagaaggtttttaagaatttggggaatactgtggctgatgatacttatgtctcaagccacagatgccatatgggctctgcgcccagttgaatcggcaccacctggcagtaagtgggcaggtccacgactgccaggacatcccttccaacacttgtggagatcaccaggaaggggggagagacctgccttgacagattttcaatgtgggcgaaacaggtctattttgagaaaagatgttcaatagaacatatgtcagcaaggaagaagagatgatgcttagttctaaagctccaaagagctggcttacactccaacttggggaaaatgcatccgggaaatgcaagattaatctcatcttagccattcttttgaatggatggacatgacccctttctacttgaagacagaaaacataaccatattgatttcaggttttcttcattggtttccatttaggattgttcctccccatcttctttctgtgtaggcatcccagttcccaagtgttcatgaagcacgtatggccttcaggggatgtgtctgtatacattgttatcttatggatgcacggttttgtctgcaccttggttctgaatgtctttactcttgagcatctgcccatgggtccccttctcaaggcctcaatttcttgagtttaacactgcatggcccatgcagcttttcagttaagcatctcttgctatgaccaactcttttcctcagtcaactcccacactcttttcagggacaggaaaaatgtagccacttgctggctgcactctgaggcctcaagaaatttagtgaatctgcctttgcccttcttgctgatgaaatactgccacatcaggccccctcttcggaaacctacaagcatctaattttcttgcttcctccccaactttctttttgactcccccccatccagagagttcttatgtctactgtactaggaaaaactcattcttaaggtatggttttcaaatcattctctggtctggactttagctacggttttaaatgaagaaacaacccagagccaaaatataatgaaactatttccttcttccacagagtggaaactgctttggggttaaagggccagtgaaccaaatagaaaaggatctcagggaacacagattgaagagagagaagaaaaaatatgaaggcattgttggttctcttttgagtttaaaatctagtggggattgtaagcacacacacatatacacacacacgcttacacacacacaccagtgaagttatgaaggattttgtcactccaacgaccttgaatttgattatctaggtcagttgttaccaaagtggaatgtacatgcccaataatatgcgtgctaaacagttggggtagtgagaaaaaatactttttatttatcttgttctctagaaattaatattttgattgtatattttatagtgtatgtgatgtgtaagttgtgtctacaaaactagtgtcaatgtaatttaaaattacatatgtctgtgaatatatatttatatagggtacatgcttaaaatgtgtttacttctgaggtacatgaacatttttcccccaggcacagaaagacaaataccacatgatgtcacttaaatgtgcaatgtaagaaaagttgaattcatagagatgtagagtagaatcatggttaacagaggcttgggaggtggagtgagggaatagagagttactgttcaaagattacaaagtttcaactagacagagggaatacattttgagatctatttcaggaacattttgagaccctcactctaagtaataggaaatcattactttagttaacatatttgaatatgagttgtgatgttctatatcgtttatttggattctactaacccacacctagatttttatggcattacctttttactcactgtgaatatcctactcatagacagatgccctgggaacttggacttgaggcacccaagaactgagacagtgagatttgggggcacaaggatctatggataagttcatcttagtgatgataaaatcaatttggcatgtttcacggacagtgtgcattttagaaagggtaaagacttggaaacgggatatttttgagcccaagtgtttccaataaatagctgtataatttgaagcaaataattgattttttgttctctttgtgccctcgcctgtaaaatgggagaaatgtattcctttctcatccttctcatgaggccattgagagtatctaatgagatcagactgtgacatagcataataattctcatttcttgaaggcctattatacactttgcaagcactgtatgtgttgtttctacttctcttgttcgtttttcctggaataaatatccccccctcctttacattggattgccattattcaccctgtaaggaaggcttcatggttctcattttcatctgagaaaacttaggctcagagaagatcagtaacttatctaaaacacacacatacacacacagacatatctatgcccattattcttaacctagtttctctattcaggagttatctctgctgtctctgcttctgattataatctgtgtaagctgatccaagtgacacgattacagggaaattgtaagccctttgagagcagagactacctattgatatctacattttaaaatttgattttagccaacctgtttatatgcaatgactaacaggttagtttgacttgcaataaatattccaaatcctagactaagtaaatttattaatgtaatgatttaacttgattttttcattggcatgtttccctgaagtcgtcatgcaaaattgaaaaaaaaaaaagtatagtgtgtgattctagattgaaattcaggaatcctccagggttaccttgtttgctttccaaatagttcagattgcttagtctgaccaacaaggtccctgacacttggaactctgtctatccctctaattgactttgtccctgatgacctcgcccagagatactcttcaccccagctatactgtgttgctagagtttctctgatatcccatgctattgtttcctttgttctcttcataaggtaccatttcccacccgccaactcctgttttcctgatggacttttgtttcaccttacaagatcattgctaatgtatttattttgagaataaaaagtgtaggaaaggtcacgggacaaagctgtacaccagacctttcccagacgaacctagtgtataatctccctagtccaacatcatggcttaaggcagtcgatagatccgtcttaatgtcccttttgagttttctactattattatatgaggatttatttttgtctgaattcctccctagatttgccctagagagcaatgactatttacagtttattcctctttgtatctcttatgttaaggccagaccttggcacatattctagctgattagaagacgtttgttgaatgaccaagtgattgaacaaatgaccatgtgctctgccacagtccggtcagttctactttggtttggttatgtgtttgccacattaaagttgtagcctgggaagttcagttgtgagatgtctgcagaacatgaaaaattggaataatgaggttatttctaaaattgctataatttaaaataaatagtggtttattccatatatgaatatacactggaaacaaagaatttctagaatactggagattcaatgataacatcattgaaattaaataaataataggattatgctagttactttctaatttactagaaattgaccgtgtgcatggcacgtataatgagtatcatgggatagttacaaaaagtggtgcttagtgagtttctgtggaaaatctcggtaccaataaaacggaggatttccagaaatcgatattcctcaaagcttgacagtatttatgcacggttacactttgtgtgtctttcgtttgaatcaatggaaggaggctataactgaaaattattgttttagtgtattatatctttaataataagagttttaagaatctatcattagaaataattattcctcaatttgtaattctcaacatttgaacaaataaatgctctgtgtctatcagttaatcttgcccatgaagatttaataaagcacgctagtttttacaaatgtgattttagagatggtcattacttggtaaaatattttgtgttaacacttccatgaatatgttctgtgggaatatactgcctccacattgcttgctcatgaagacatgatttttcacatcatcctatcagtattttgagaaagagattgatcccatattctatgagcatttgaacattctctagtatttttgtttaatcattaaaacaacccttgaagtctatgtgctacactggttatttccctcttgactttcctttacagataaccctctatcataaacaacctatctatatttgttgtctccacatcatgttgccagccctgctttaacacactgcacattgacttctagcagcaaaggctcatgggaggtactctcatcaaggacactgatggtcctcatgttgctaaatttggtgggtcctctacagtctttatcctagttcaccttattatggaccactgtcaactctgttctgcttaaaacactctgttccttgcttatatgactctacactcttaactcctttgtgaattcctcatctgcccttccattaagtattgacgacatccttcatagttttgatctaggacctcttttcctcttacttgacattatgtgggtaatcttgtctttgaacgcaattaccattcttatgttgatgacccttaagctataattccagcccaaatcatttttctgaggaagctacaagaatacacaaatgtctaatagatctctatttagatgtccctcaggtgcttcaagcttaaaatactcacctgagctcatcacctcatctataaattctgcttctcctccctggctccctgatttatttaatatgaccaccatccacttagttgaataaagcagaagcctggacaccatctatacctccaattaatcactaagttttgttgttaaatacgttcttacattttctctctagaatgtcttattttccccatctttacacccaaaaccaaaagtcagatgaccctgatctcctgcttagatttcaaaacactatctcttgcctagactctggaatttcagtcttgctcctctccaatctatttctacaccctagactctggaatttcagtcttgctcctctccaatctatttctacacaaaagctagagtaattttttaaaaaacaaaaatctgaatgtgttcattttctgcctaaaagccttcagtaattcttatttgttcttccagggatagagtaacaactttcagacctagtttattagctagttctttaaccacaaaggactctctcacttgtctactccccctaacacacttcgccctaacctttgccattcctccctttcccttttccttcccagatggacttaagtcctttcagattcttaaatgtttcttcctccagtctcttacatctcttttccttgtaactctaaaaactacttagcttacgcaaggaaaaaggtctgtacaattcccggaatcagcgatcctaacgttccctgttgtttttttcgttgggacatgaattcattcacagtggctctaaacatcaccacccctgcctatctctcccattcctactttatctgagcttatccatactcttgaagacttacatattttttttctaccaggaaatcattactagccttattatcccactgtccaaaccaataagtctgattaggtatctgtatatatttaatattactatatgtgtttttctaacactctagtagaggagaaggtgtatttctttctgttttttagaagcctgtatttctgctattatagctcttaaggaactctcatgcaattgcctactagaatgtaagttacggtaggataagaactggatcagtcatatcacacatccacatataggacctagcaccatatctaacacacagcaggtactcaatacatttctttcccaaataactaaagagtttaaacaaaccaaaatgattaaatgagaagtaactgttttggtaattcttgtgtccttactagagtctaaattgagtgatttttatatcatcagtttatactcccctttcccaaccccaattctttcttttttaaattttttaaatcaaatatgccttaaaacttcaggatcagttgagtaaaatgatgcttttgtcgtcttttgcaaaataattgtatttcagaattttgatttagatattataaacacacctaaaataatagctttagtcttaagatgaagtgcttcttaaactccctaagatgggttggactatggatatgaacatggacaatatcacattaatttgtgtacacagttctaacacagggtctggcatataagaacaagtcagtaaatagttgttgaatggaattgaaaatttaagtagcaaataaagtattttgacctacaaagcaagaaatcacatttttctttttgtcacagttccttaggaagataattaattttttagtatttaaggatgttaaatatttattttatgttctatttactaggcttctttttatgaaaattaattggtgaaaatagcgtacatatcttcctttaccagaacatttacattttgggcagtaacgctggcttttgttaaaaaagcaaaatatgtgtgaaatttatgtttgagttgatttcaatgcattacatttccattttaaatcttctttgaaatactctatttttgacaccatgaaactgtattagatcttagtatgttagcaatgttttgcagttttagagccataattattttaatgaccactttcagcatatacgttttctacaggaaaaataatctcaagaacatgaaaagtgaaatctatattttgggtttcaaaatgatacattttagctaaaatatcatagttttaatttctcagtgaaaaatatagtgtggtaatttatgaagagactcagtgtttaaaaattatgactctatagtcaagtttatgtttataggacataggttattcaattacatttaaaataattaatttagaaaatgtgatcaatgtaacaaattttacctgttcttttctaaagctaaatttgttgtttgaagtgtttcttctaaaatgctaatgaactatcaatttaattgttgagcttagagttagaaacttaattatattgccagaaataaagaaacaaatggatcccaaaagattcacacattagaaatgtatgccagggaaatgcttttgaatgtgttcaagtcatggcttctaactcgtaacttataacttgtgttatgtctggcttcattcccttaagaaaaaggaataataatgccttcggagagcatcccagctgtaagagctatgcattggtgtctaaaaaagcttctcactcctcataccatcctggtctgggaatttaaaaaattgtcatcttttgataatctgtatcacatagtcttctgcatagtcatatgaggttagaactgccccataacttttgcagggcctatagtaagtgtgcaaatggttgcctgcatgccacatatttaatatttataaggtataaagtcaacagactattaaatatatcctatctgctttccttgacaattatacaatcataatgatatggacatctagattcgatttagaattctctctctctcattttctttttcttctttctttctttctctttctttctttccttcctttctttctttctttcttctttctttctttctttctttctttctttctttctttctttctttctttctgtctgtctgtctgtcttgtttttttaaatagtgcaagcagtttattccctggcaaggaatttggaaaaaactcaaatagcaaaccacttgatacaataaaataaattccttagagttttgtactggaatgaggcagcttggttagagctaaccctaagcctgttatttaggatacattggcttttcttaagcttaaaaaaaattttactgtgttaatgacatttaacatgagatctatcatcttaataaatactacatgcacaatacattattattgactctaggtagaatgttggacagcagatctctagagctaattcatcctacttaactgaaatgtaatgtctgttgattagtaacttcctatttcgccctatccccagcccctggcaaccaccagtccagtctttgattttatgagtttgactgttttagataccttatttcaagtaagtggaatcatgcagtatttgtctgtgtctgtcttgtttcacttagcgtaatcttaaggtccatccatattgtttcatattgcagaatttccttttataaaggctgaatagtattccattgtgtatatataccacatttatctattcatctgccaatgggcatttaggttgtttctgcatcttagctattgtgaatctgttgccttttttccctacctcctttactccatcctgcactgtgaggaactctgtgcacatagatctggtcgccccatttcccacccacatgttcaagtttttcccactcacctcatgcaaagatttaccccttagccatacccagtaactgactttgaaacatttgcccagggagttgagggattctgaatgccagatcatgggagcggggcttctagtgagcatgttggcttggtcctacagactcctaatcagagctttgcctttgaaagcatggggcccaagggcaaggaccctacttgttaaggtctaaattttttttctgaaataaccacatcgagcttttatgtgtagatggcctaaattgggctaacccagaggcagtgacactcaagtagtttacatctaagcgctttccatgtgcttcttttcccatttctgttacttcttacaaaataaaaaatcagcatctcaattaccctgatttgatcattgagcaatctaaaaagtatcaaaatatcacatgtagcccccatatacatacaactgttatatatcactataaataaatatatacacattatatttaaaaatcaatactttaattttacatgtttaacaaatcactagcatatacattccagattgaacttacgagggatgtggaaaagattcagtgactaaataacaataaagtactctaaaaatgaaaatgtgaaatggagacagtataaatctaaaatcatatcacttatgaagtattgtttcaaataaacaataaaatatatcttcaatcaatttaattttattttagttgtataaaatctttcggtcagcattaacctaattggaacactaaataggtacatctaaaaaatataatcccccccaaaaatatgtagctcataagagataatgcattgaacacagataatattggcgttaaaaacagaactctaccacatttgcaacgaaatgtttatctgttcttcctactagaaaataataaaatagttctgcatgagcttgaactcgaagtattaggtgtacaaagaccttttagtgaatgaatgctagctgaaaagcaaattttaaatatgaaaaattagcaagacaaacatttgaatttgtgggagatgagtaaaactcctataaaaatgaattgtttagtgttaaacagattgtgtatgaaatattaatggcatattgtcctgagctccccttccgctgtttccatgtagatgactgaatttcaaacagaaatatgccaggaatgattacgtgaatgaatattactacatgagattgcttaaagagtatttcttcttttgccttctttttactttcgttatttcatttagtagttagaaaatactgtctacaaatatgtgagaactgcttaatttatttttgagacattaattaattcaactaaactatattgactgtgtgagagagattcccttggtgaatatgtggatttttgcggtggtaagaactctcctctggagcgcaaatggtattgctctaggaataaagcatatacctcaggcccagatgaaccagtgcaatctacagtaacaggttcaaagatgacctcatgacctactgtggactaataaaaatcaaggagacctactgcaaaggtttctgggaaattctttttctcttgcgttgaactaagtaatatacatatgtgatagttagagctgcagcctttgtaataccatgacagaagataacctgaaataaggctgacagacacaagagggagacctaagagtactgagagatatggagcaggaccccctgattgaacttcacttgcagcccccttctgcagttttcaatgacgtgaaccagtagaatccctttgtttactgtttttgattaatttgagtgcagctttatgttatgagcaactaatagcatcctcactgtcacaactgccctctatacggcaggcactttgtgatactaaagaaagcagtatacagagtagagcccagtgaataacagggcagatgttgcaattaaactgcctgtttaaattctagctcttccactagctaacttgtgactatctaagtaatttaaccttcctataatcatacctatcttgaagacttgttgtaagatttaaagcacaacagtgctactataaaacaggtatacagtaaagcttagctacttttttattaggccatatgatatcatttcattaaaatcttatagccatgctataaggtattatgatcctcaatttataaataagacagctcaagttttggtcaagtgactttaccaaggtcatagagctagaaaataatgattccaagttacaagccaaacctcttcaatgccaaatttacatcatcccccattacttgaagtgtaagattcacatggacagaaatttttgactgtttgatcactgctatctccttatcatctaaaacagtctctggtccatattaggtgttcaataaatatttgtagagtacataatttccttcacagactccacaatctggtgaaggaggcagacatgtaagagaattatttcaggattccacagttgatgctgtaacagagctaaatataatgaatggaggaggaatgaataagtttgtctgggagcaatgctatggctattgaaataagtcttgctcatgctttgattgaaatggtggatatagatcacacaacaaataacaattagataacagcttgttgggagaaagcgaggatcagtgtttgccataaacatttctcatagctaatgtcaggtgtttgatttctcaacattttatatctttgactttgattttctctgtttttattttttaactccattctcaagaagtctgcacataagagtttcaacatctagcacttcataactccgtcatctcctctcaggcttagagcaaattctgagacgtggatttatcgtcgagtgatttcttcctggcattttatctctgagaccaggatctggttgctaagcatgtagacatagaaatgcatttcttcattgaaccccataggttcaaactagtggataatgagcacaatgtcaatgtgattatttgtaatgggggaaaggttaccggagaatattacacgaccatccacatagactaacattttcctcatgactaagtttacttagcaaaacaaattaaaaacagaagtttgtttagcagcacagaattgaaggaagacaaccagatggttatgaggaagattcatccaaactatgccagaactgaaagaaattaagttcattcagtacaagaattgtctagaataagagaatccattttgtgtcagcacttcccaagttcttgttaatgctaccttaagttcaattcaaaccaggcagcatttattacgtgttgtgctgggtcctaggaggaccgcgttttaagaacttactgtgatcttctagatcaagtttttatttcaatatttctacctcatttctgattcttaggtgttccttatttcccaatttatcccctgcagaaattgaggcaataagatgtctatcttattgcctatggtgttgattatttatgttatattctgttttgtgaagtttgacctctacctaattaaattacattttcaattgtatcttggattgatttattcaataagtattctttaatatttttgcatgaggtcggtcaggtttcatcagacattaggaattaattataaaaatctctagattggtacttggagcttaaaggaataaggtggtggaacgttaaatgaggaggaaagaaccagcagagctgggataaaattcatctctatcatcttcccacctgcttgatctctggcatataatttactatccgtgaacctcaggtttctcttcagaaaagctgcagggttgttgggggaaataaggcaattcctgggcttcagtatgttcaaaacagagcattaatattattatagacttttgatgatttacacaattttagctttttggcaagacatatttactagtactaagtaaaagcacgttgactttctaaaatgaaaatgtgtatgtgaggatgaagaaaaagaaagtgttttgtttgataatatagcattataacactgcacaaaaaaaaaatggtatatgcagagacttccatcacttgcttatgatgccgcattgggatctcattaataagacacttcctcagacacttcctttgtgttcaataaatttcaatttcctcctttccttcagttcacttcaagaaggacggcagcaactttcttgttgccaaacctgacaaatgttttttagtgctgattatactcgagcattctgtagcaaaatgctgtgggtgaaaatgccttccttcttaagggaatttagcttctgtagtaccagaatctccttgttgaatgaacatgtactgcctaagtcttagtaatccctcctttttgagcccattttctggcatctctccctttaatattcctcaaaaagttggatttttcctggacttttcatattacagactttcctttggtcatcctcatccattccgtgattccaactacattttccctccatcctggcatcttctttcttccagacttgtatatgcaactgcttccattcatacacttgaccaaccttttaatttctataagatcaaaaactcagctcacaagctttcccctaccatcgagcggggttcttcttttgcttctttgtttcagacaatggcaccaccatactcgagtaaggcacgttcatttatcaggtcctaccaaatctacaataaactctcttgaatttatccacttgttttcatttgaacagtcatttctttacctgggtagcctgcaccttctacctgcattgattcagcagtctcttcaccactggctctccctccctctcctgcctctcttcttgctccttcaatttattctctactcttcatagtgacttttattaatgcaaatatgaccttataactcccttgcttaaagacccactcatgtttgtctttgtatccataacttccggcctagggcttaacgcatagcaggtgctcagtaaatctgtggtagatgaaagaacaagttgtataaatactgaatggtctgatgtgctctttgttgtgtcaagaaggacattttgcagtcaggatagctacatcagtcctttagtaggcatttgacagcactcgcattattcctcaagagaagatggatgtattgattctgtatttcaaatgacataacttttgtgaaataagaggctgccacggtaatctgagggatctctcaagttcaagggactccacagtgctttgtgtaaggtaacaggctaaagggttcagtcttaaactttcttaagactgtagttcagggttcctatggtggggctataaccctgaattacatcctctttcatttcatgctgataatgagaactacaaaccaaggggtattaggaaagaatccaggtttgatgcagggaaaaataaaaacaactgataatctctagtgtccccaacttcaagaattcctttcttctttacaccaagctttttttctctgccaggacttactttgtcttctacatgtttaagggagaaaaatgagttaacagaaggggaggtacagcatttctatttacttagatgctagagaacaggatgaaaggtatgaaaaatatgaaagtctctctctctctctctccccagccttcccccgcttctctctctctctctctctctctgtgtgtgtgtgtgtgtgtgcacgtgcgtgtgtgtgtgtgtcataatactcaacctttcttttctttcaagcatatgttgtggcagagacaagtgtacatcaaaattcgtggtccctctttcatagtatagagttcttgctaggatccagctgcaagccagcaactacatttcccagccccactggcatctagttagagccatgtgactagttgtgaccaattgaatgtgagtgggagttatgttgcaggcataccttttccatcttcttacttcccatttgctaaccttatggaaaagagtcccaaagacctaggagatgaaaaagcctaaaatggaaggactcagagtccctgaattactgggtagagaaaagctgtttgcagatgggaatgcccattttgtagtattctttcttttcttaagccactaaaattgtgggatctctttgttatagctactggcattaacctcttacgtatacatacagctatgtgctacaaagaggaatagatacattttttaatcgttgaaaggggagaaagaaacatatttaggaggaaaataatttagtctctacaattgaaaagtgttttatgaataatattttgttttggcagcatattaaatctcaggcagctgaactacattaattttcaattctctatatatgtttttgtcttcagggtttagtaacactgatatataacagtttctttcttttaatttccaaatttaaatgtctaagtttgccttctaggcagaaattaagtcccattgtggaatgagattggatcaacacttcaccaagatcattttagttctttgtaatcttaaatgaaataagctaataaagcattaaattagcatgttgtaaaacttcgtgaagttttaatatgcttctaagtggcagctcttagcttattatctctaaagctaaagtcaaaataaatgtctcagttgatgaaatggagatgaggcaacattttatcaaatttaacaaaatattttatatctgaattataaagtccagattatctagtaattatcatataaatgtatttaaccagacatgcatttttctctaatcagtagccctggagtctttggaccacaaatgtgccttatctcaaatgctttaactgtgacattttgctttagactagctcgactacttctacagaaattatacacttcattcacattcatccagatgaaaaaaatacatgtagaaatgatcataataagtaacatttgtttaggatttcagagtttacgaagggtttttctattcactttctcacttgttcttcatgtaaactggtttggtggacaactgtcattatccctgttacctggagcccctgggtcttagggagacttcttgacttctcaaggtcatgaaggtgctaactctgaccgtgtttttattcctactgtgccacacttctcaggtaaaaatcatattgcagacactttaagagaagtacttaagaaaataaattcctccagagaattacatttaagttgtttcattaactgcagtgcataaagaaaggaaaagtgttcccaaacccatgtagtattttgctattgcttatggtaatattctgcacacctaatattgtcagcataattttccatgtaacaaaatgtcctaaatcagcaatgtccaatataactttgtgtgatgataaaaatgttctgtctctgtgctgtccaatacaacagccactagatacacatgactactgagcaatggtaatatggccagggacactaaggaactaaatttttatttaatattaaataacgtttaaatttcaaaagccgcatgcggctagtggttgtcatcagatactgcagttatagaaaattagaatttacctctttaaatactaaacctatttttaatagtaggatttttaaattaaaatagttctaagtgcttttaagtgatacgaagtcaaatgcaagatttctgttttaatagtactctcaacccagagacaatcttcatgcatccttatacatgttctttgttgccttattctagttttattttaacattaaatgcctctgttctacttgatattgacttgcttcagagaacaccaagtatagtggaaagaaacacacacatgaggacttgaggctaccaaccaggttcaactaaatgcactctgatttaattgtagtattgggatcccctgttgcatttattgaagaagaaaaaaactttgcaaccaaaaagatatttgaaagcaactgttcttcttggacacatgatccctcataaagtggggcttcctgcttttcagagacttaatttctgttcatattcatttcagcaatagtaataatgatgatggcgatgatgataataatcatgatgatgcctaagtgttgtagtaatgcttcttctgagccagacgttagtcaaattactttctctacattaattcaggcaatcatcacaacaatcccacaggacaggttttattattatacttatttagctagcaaatgatataactaggttaagttacttgcccaaggtcatactgccaagacagtggctctagtgtccctgcttctgaccatatgttatgctgcctatcctagagcttttctcttctaaaatagtaaaataatatattctttgtttgtttcatacttttttttttttttttttttttgagagggagtttcgctctttcgcccaggctggagtgaggtggcgcaatctcagctgactgtaacctctgcccccaccaggttcgagtgattcccctgcctcagcctccgaagtacctgggataataggtgcccaccaccatgcctggctaatttttgtgttttcagtagagacagggcttcaccatgttgaccaggctggtctcgagttcctcagctctggcagtccgcccgccttggcctcccacagtgctgggattacatgcatgagccactacacccggcccatacataaatattttaagcgaagtacacatgcatgatcatcatacttttaataatttcatttaactgtttccaaagaatgttagtatgaggttttctttttttctttttataatttcaacttttattttagattcagcgggtacatgttccctggatatagtgcatgatgatgaggtttgctatatgaatgatcccaccacccaggtagcgagcatggtaaccactagttcttcaacccttgcctgttcccttcctccctccttcctctgtagtccccagtgtctattgttcctgtctttatgtccatgtgcactcaatgtttagctcccacttttaagcgagaacatgcagtactcgttgtctgttcctgcgttaacgtgcttaggatagtggcctccaattgcatccatgttgttgcacaggccatgattttgttagtttttatggctgtgtagtattccatggtgtatacgcgccacattctttatcctgtccaccattaatgggcacctaggttgattgcatgtctttgccattgtgaatagtgctgtgatgttatatgtactttttggtatattcaaagagaaatgctattttcctcttgacatatttatgtcaatttaacatatttatgtcccttttctttttaggagcaccattctcttcctttaacattataaataaaatattttttgcttttctgtttttgtaagtgcagttttattgacagagtgagacatacacgtcgatattgtgactagctgcatgtcttctattatttagaggtctcactcaaatgtagattatcaaattctgttagtgaagagggtagaacagcagaactaatgctggtttccttctctagcattatttgatgataaactaagatgataataccccccaggtcttagatacctgcagtaggacaggcaccctacatttaatgctcctaggaatccttcaaagtgatagcatagttattatacagtaattgagaaaactgatgttcataagttagaaatttttccgaagttgcaaagaaagtgaatggaagaattataccaagttctggccgggcgcagtagctcatgcctgtaatctcagcgcttcaggaggccgaggcgggcggatcatgaggtcaagagattgagaccatcctggccaacatggtgagaccccgtctttactaaaaatagtaaaattagctgggcgtggtggcacgcacctgtaatctcagctactcgggaggctgaggtaggagaatcacttgaacccgggaggcggagtttgcagtgagccgagatcgtgccattgcactccagcctgggcgacaagagcaaaactccgtctcagaagaaaaaaaaaaaaaaaaaaagaggattataccgagttctctttgattccaagcccaaacaaatccttttttgcaatatatgacattgtttccctgtttgcattccccattctgtgtatcacacatcctgtggcctgatcaaaattcattttcagattctgaatttattttccattgaatctatataaactataaagacagaagatatatgtatgtgtgtatacccacgtttctcttccagtgtcaactgataaaaatagatttcaaagtctcaataacctttaattccctttttctcttaaaaattctttagaacttgtacatgacattctgactctagcagattttagaaaacagagaggccattagatattcataccttactattcagatgaagtattcaatgctaaattatgtaatttatctgctttgcaaattgtatggtcagattgagttccacaaaggagagataatttttaatataggcattctgtagcttccctaattattgaattagtttagagcaaaatccttaaattgtatcgttgctatgctcaaattttgtatacttgtccacgtaggctatattaagatttcattgaattttggtttctttctcagtgataattcaatatatcaactcaccactcagatttgcctttgggaaaatccaggccccttttctggatttttagagcagattttaaaaaagtgattctgtatatgtgttgaaattaaccacatctcattgcttttgaatgattgaggtaatgtatacctactactttaaaaaaaatgacttacttagaaggtgtccatagttttataagttccattgaactggtttatattgtatttagaaaggaaaactactccttttatccttaagggtgaaaacctggattttattatacaattaacacatatttattttttattatgaaatatatcacaatataaacgtttacagggagtgtttaaagtggtgttgtccaatggaaatataatgtgagtcaaatacgtagttttcaattttctactagccatattagaaaaagaaacagagaaattaatgtaataggatactttatttagcctagtatatccaaatcacaattatttaaatatgtaatcaatataaaaattactaattatgtatttaacctttttctttagtaagtctctgaaatctagtgtatattttacatttatggcacattgcaatttgcattagtcacatttgaattgttcaatagccacaggtggctaatggctaccgtgttggacagcacaggtttaaagaataatatgaacatctgtgttccaacattctgagtttcaaataagaagaacaccatcagtattttgggagaagctccctatgttaccccttgctaatcaccttccttccccccagagccaaaagtaaccattatcttgaatttctagtaaacaatgctcattttttaaaaaacgtatgttcaacacctgtatttgtatctttaaagagtagctagttttagtttgcctggatttgaactttatattaagggaaccaccccatctctaatcttctctgtgaattcttttctctcaatactatgttttacatatttacgttcatcaatgtgcaactcattgtatgtatataacacaatgtatatattttacatgcgtatggacatttgggttgtttttatgtttttgttcatcacaaaccacaacacacatgtgttcttgtatatgttttatagtgcatgtttaaaaatttctcaacagtattcgctagtagtattgtcaggtcatagggtatgcacacataaatagaaatgattgattagctgcaatttgtagtgcacacatatttgctatgtaagtgatccatgtttaagactttaactgaatttaaaaaatattttattggagccaatctaaatgagctaagggtttgtattgtttacataagcaaagattacacttactgggtcaattcggttgattaactttggatatataaaatatatagctagttgttaaatagatataattattaattggcattacttttgtttgtatataaaaatttcaaaatatccatgacttaagcaaggtaaacacccactgggtggcttaagcaacagaaatgtatttcttgcagttccggaagttgaacgtctaagattaaggtgatgacagggttggtttctggtgagtcctcccccattggcttgcagatagccgccttctccttcatgacctttcctctgtgtatgtgcatcccttgtagctgttcttccttttatgaggacattagacttattggattaaggtcctacccatatgaactcatttaaccttaattacccctttaaaggccctacctccacttgcaggggttaaaacttcaacatatgaatggggttgaggagacctacttcagtccataacagtttctatattctgaagatggtctttaattaactaaacagttaatgttactttactgggaatgtcttttggatgggggaataagctgatgatatgagaagggttggtgaatttctcataagtgtgaaatttgttgggccggcccagcatgattttcaatcaaatacgctttggggacaagtaggttgaatcactacgagaggtttaaaagaaagcaagttgtaattgcaacttttaattgaaagaaagacaggctttgttgatgtgccagcaagactgataactggctttaacgtagatagtaaggcagcagattcaatccactgatcgtgatctactagtgaatttcaaagccttatgcaatagaactacaaaccctttccttgcccaccttgcaggtggatccataggcaaaatgaacatttgcaaaaaagccgctatgtttcagaatttgtgctagggctttaatatctataatttctccaaatcctcacaatttaagaattaattcaacttagccccatgaatagggtgaaaattctgagatttaacaaactaaaataagttatctgaagacagacaaatagaaagagttgagatattctatttgaatgtaaaattttcaaaaagtagaatgacagcgtcaggaattacagtctcagtgttgaacacaagacttaggaacaaatttgctgcatgtaatttcattgagatgggacaaagtacagcatacgtaaggaagttttagaacaaataagataattattttacgagctttgaaacatgtgtaagaaagatacgaataaaagtataatcacatttgactaaaacatgaataccttaaaactgaaaagcactgagattatcattatataattttgaatattttaaaccacaatgctttgggagtgcactgtaatattttagaattggaattttaacttactggcttaaaaagtaatgtactttgttttaaattcaaagattatcttgtaaattcagttcgatctattgaaaaaattataaaattcggcaagaagccaaagaagaacaattatgtagctcaagataattaaattttcatgtttggctttagaaatatattcgtcgtgacatagtacatggtaatctagtgagcccagacaagtagttttctctttttgtcaaagggaacaatttgatgcgtgttcaagttgcttaaataaaattttgtatgtgctttctcatcacaagagaacaatatgatttttgaaattatttttactttataaaagaaaaaaaaaagccctcacagagaaaaaagaaaaaaatgatgatgtctttgaaaaacaaagttaatacagctttacatatatttgacctacatcagggttaatatttttcaaggtgaaacattagatgctggaacttgcaaaaacaggcaatcctcctttagatgaaacggacactctaagggttaattcattcactgagacctattgtgaagtaagccctacagagactgaaaaagttaaatgcaactcacaaaagttgctagaagagtcatgatgttaaaataaaataagtacacaatgtatgctgcaagtatacttagagccatgctaggtgcggttgagaagttcaatacaggtccaagataatagctgcttctcctatagaacatgtcttctcattggagggataagacctgtgtctatgaaacaggcgtaattacatagctctggaactatatatgccgaaataaatgagacagtaagtgttattgtactataaagaatgaagaaatcatgatgagaagtaacagttaatgaatgttttctagaaagagtaggatctgaattggccttaggttgtaagcagagtttatagatagagtagtggtatgtcagagtcactctgggtgcttaaacatacaaatccccaagtctcacccaaatgtgtcttcagatgaaaggaaaaaacaaatgacttgagctcccccgcaaagaacacgggtggtatattgagcagccaaggagtgaccagagtggcaggcccatgttgagggacaaaagaggacaattagaatatgattaatacaaatttacagtgggatgagttgttagcctgaggagcttgaatgtgaacctctgtgcaaaaaggagtcattaaatacttttgaaaaaggtgggatgggaagaaaatgacattctcaagacaattagatcgaacagtattaagcatgctgacttattaagttatgcaccttgagagggtggaatgagggaaaagggtctttatctggagtaagacaggaagaagctaagctgtaattcttactggactgtaaattatgtgcagatatattatctgtcatgttcgtgggcgcattctcagtacatagcacttgaaacaggtactcgataaattgtcaaatggatgcatggagtgatttccatgcaaaatctaatattgtatagtattagaagggggaaaaaagcatggcattatgctagcagaaatgtcatttggtattgaggatgaaacattttcaacagtttgcaaagccatccactcaaacattctgtcactttccaataattttgaaggatgttctttctacttctaccttattacacaatgagttgagtaagataaagaagtcatgtgcaacaaaacagagggagattttctgaaaggcactacaccaggaagttgttgtactcttgcttcatcttgccatcttggatatacttctggcgctacctccaggccagttcctcgttacatatgtcatttacttcccacatgctagactcaccgagttaatcattttgctgcagttaacacattttagcagagtgtaggtttatgggtgagaaggaaatcaatgatgtttcaatacagggttcttttcccatcccccttatttccacttagaactgtctctcaagtcttaatttgcctctaaacttttttcccagcttacattcttttctgaaaaatgcaacgacgatgccaatgtttgttgacctgaaatacattgtaaaacattcataatactttgagcagagcttccaaactcccatttgcctcttttatctcccttaccttggcccctttttgaaggcaatgtgatatttaatccgtttctattgatgcttcaaaattattgaaaaactggtaattgtatttttccctttacttatcagttgctagttgacaatgagtgtttgcccaaacaataaccaatcaaaaggtaaaaaggagattccagacatatctgagaagaaattctttggaagaagcccgtaaatggaatgggaattcaaacaaagccgtttccaaaagaaatactaaatggtctctaaatgcaaaaggattgctccccaagcattttatgggagcataaaaagctcccaacacattttatgacaatacttctactcaatgacttcttgtgttgacatatttgttgcactcgacgttagtatttacagcttcttatcccaaatatttacttaactgaagccctgatgtttttaaaaacttttcatctgtgtttaacagcccattttacagaaacttatttgtttcatcaggcagatatttactgagaacttgcaagtgccatatattctaaaaatgctgatgataaaactgtgaacacaatagattctcatggtgcttatggtcagggctagcacacacacttgtgaaatgatcactgatgatcaaaggcataaacactacatttggaagaaataccgagggatccagaagtatcttggaaacactagcaagtatagcagatggtgggattggtgcttcaaagaacttcttgtggaagatgttacgtatgtaccttctctgtgccaggcactgctaggaagtgctggagagaaaaagatgtgctagataccgcctctgtcctatgtgcttgtgctttgtggggaggtgagtaggataatcccagttctcatgcagtgtaatgagtaccatgacggaaatgcactccaagaactaggcagcatgaccagagataggacatttgagaaagacttcactcgggtggtactatcttagtctgggtgctaaaatagatgtgatagatgagtaagggtgacccggaagcaggagggaaagggaggggctttcagaacaacaagtgcgaggacattaaggtgaaatagagtataatagtattcccagatccttgggattgttctccattaggctaaaacaaaggtgttttctcttctttaagatttcatgactgcagattgcataacagaaggtcatttaatagacctctaaactgaaggaattcttgaattaaatcacaacatatcttccatggccagagaaaccattgcctccttatgtcgacattactaacagcaccagcacctgctgctcaggccagcgggagggttgggtgttgctgcctaggtaatgctcaccaactgatgtcctgccatgagtagttttgccaagttccacaaaaaaaacttagtgttctatcagcatctaatgagaattacagtcattagttaaataaaagaactattagataaggagcagaatgaacaacacacaatccatcagcttggtgaatggtatcagatggtttctgggtgctgggcagctgtgcatccaagtagacagggagaatatatatgtcctttgccttatgtacttgtttctctaatccaaaggcacagcaatccgtggaagctgctatgataaggtgtttagtggtgaaaatgtcttgaaagccagtagattattaaagtgatgtttttaaaaatgcagatggagagtaagtactttttatctagagtagtagttctcaaagggaggtcccgggatcagcagcgttagcatcacttgggaacttagacctgcatgggccccattccagatctcacttgaaaactctagggggtgtagcccggcagtctttgttgtgaccagctctccagggggttctgacactccaaatgttcaagtttcagaacgctactcacaggccatcatgctcggcatcacctgaaagcttgttagaactagaaagtcttggccccaccccaagcctactaaatcagagtttttgggagtagggccaagaaaactgtgggttaacaaggtctccaagtgattcttattcatgtcaaaatttgaaaagcgtcgatcgaactgttggttctcagctttgattgcgtatctgaatcacctggggagacagttgagctattccgggcccagatcacatctagaccaattgaatcagaatctatggaggcaggacccagacatcagtattttaaaatatttcttgaatgatcccagagtgtagctaaggttgagaaacactgttctaggattaaaggattaatgtgtttgagagtatgttaagatcttaggcaaatcacaagggtgttaagaactaccatcttcgcaaaaggagaatgtgcctcagatattctggtactgctttgattttaccttcagtagtcttacctattttgagtatgcttagtagtactaatatgaggcttattactaatatgttaaaatttgtcttttaattaagtgggtctaaacgttttaatctttaatctctgacccaactagaacttttctaaacattttcataatagtctccaccttgtcttctgaccttcacttatgttctttcagggttcttcgtgtgttactagtaatagtaatggcaagtgtttattgaacacttactatgtgaagattctaactggcttttaataatcacatcagctctgggaggtagaaggtagggatcctccttgcttatcaggtgagaaaactgtactatagagaagttagcaacttttcccaggtcataatatgtgacagctaaagggagcataatggttggaataaaataaatctactctagttgtaccgaaggctcatatttgtctcacgtacttgatttggtcgaggcccaaggggtcaatttccaatgcttggattcctggatatgtagagttgtattaaaaatgctaaaaacctattatgtatcatacaatcatacatatcacctaaagtattatggaaatgaatctgtattattaagggaaaaaggcctgtgtgaagaacaactgaaacttcattttaattgaaattaaataacatgcatcatacactaaaagtgcacgttatgaccccatgaattacttcaggtggctttgattcatgttacatacactaacaaatatagaagagtgatataatgcttcttaattaactactaatggaagtttactatttaactgcttcttatgtaagaatgtaaatgttttctgaaatatcagaacttttcattaggaagcacttttaaaaatagcaaaactgatatgcactatgatttccatatacattaaattgaacttgtaaatgatgttataaattatagaaaccaaggggatgttcaaattagatatttgtctaaataaatcatgtatggattgaacaaatactcattgagaaataaatgtattccttttctttcaattatctaggattccttgtttatctcttcagaagcaaaatgtcttctgtccgttttatttccagttaaacattcttcagattatgtaaataagttaacttccaatcctcttatttctgtttatctcaccactcttctaatttagacgtgatcaatatcttatctttttgcatttcatagacatcaggatccagaataattgagtgagctcaaaacaacaatggcaagaatgatgttttcagaaaactcagcaatcattcgtttaataaatattcattgcctaccaactataagcaaagtattggctaggccatgtggggtatacaaaaatgtattaaatatggctcattctccctaagaacttacacctattagacaaagtacatgcataaaaattataatgtataatagaaaataaatacaagccctagaatgcacagttgaagtacgatttgcatttattataaaaagaaagatgaattggctgggcacggtggctcacgcctgtaatcccagcactttgggaggccaaggtgggcagatcacgaggtcaggagttcgagaccatcctggccaacatggtgaaactctatctctactaaatatacaaaaattagccgggtttggtggtatgcacctgtaatcccagctacttagcaggctgaggcaggagaattgtttgaacctgggaggtggaggttgcagtgagccaagatctggccattgcactccagcctgggcaacagcaagattccatctcaaaaaaaaaaaaaggaaagaaaagaaaagattaatttcctgttagctaaatcaaggaaggcttcatggagaaaaaaatatttcaacacacacttgacgtagcagtgggatcaggctgatgttagggaagaatgaatgacattctacactgagaaagagatattcagtatatatatgaagagcagtagagaaactaacaagtggaaatagactcaatttacaatacttgcctgcctggagtactctatacgttgactgtaagttgcagtttactcagaacaatcccactttctacttgtttatcctatgtaatcatttattgggcctccttttgctctcaaaaatatccttgtttggataatagattatcactctgttcctaaatgaactgccctgtgtcctatcccagtaaaagggtgcattcgggcccttcgtaactgcctccactacatggttgattgaaaccagagcttggcattaagaagttagctgaacaatcagatttctattcttggaaaacccaagaatttcagaatagatacagaagctgtatagctttaataacatgacagagttgtagccttgaaagctatgtacaattcagaattatgagggagaagaaattgaagaaacagtagcagccgggtaaatgcagaaacaaatgagggagacacctagggggtgactgaggcacaataatggaagagaagtgcagtgaaattgcttgaactcttactgatgagatttctactgttgccttgaatccaggaccacctatatgttcattctttgtcatgctcagagttatgacagatgctgttattgaattccccagagactcccttatcgtctcacctcaaaccttacaataatcccttctatctttctatccatccaagctggcttaagtaaagtctatgatccatattcctagtaaacagagaagggaaagagactgaaggcaaaggccccaattagtaggctattgcaatatttcagggaaaaggcaatggccatcacattgttgtcccaggaatgagaatagaaatgaaagaagataatgaaagttgaaaggactgggggggcttgacaactgtttagacttgaggagtcagataaaataggaagccaaagataattcagaatattttgattttgattttcatcaccaaataagatagtagtactatgaagaaaaaatggttaaaaaacaataataataaagagaactcctccaaatagtaccaagggagggagtttaatagaggaaattaattccgtaggtgatgagagtcctgagaagccaaacgagaaaagatcaaaacaacccagggattggcagtcgcaggaagctgttctcacttatggctggggctttaagcacaaggtgacatgagatttcagaatttgaagtcgtctggaggcagctaggatcaggtggggcctgtcctgttcggcaggacctgcaaccacaggaggaggatgcgtcaagcagaaagttggaacacaagaggggattcagccataagccacaaaataccttccagagcagagagaaggagaaataccctgaattccgtattttccctgccatttagttccctgctattgccacacattgacgtattccatccagagaagtccattggcatatgagtctgggaaatgtagttcccagggggacatgatcttaagggaaatagacaatgactggtgcaacaactgacctgtgtgaggcaggagggaaaaaacaggaataatatagtttttctctagatcccttcatgcacaaagatgcaaaagaaatgtgttggcttaatgagccattctgggtggccctgtaggtggctgtcctacgaataagatttttagacaaaacagagatgacttcaaatgtcacaagaaaagtatcagacaggaattaatattgacttgatctgtcacaggcgtcaatgatttgcattaagccaacgatcttcattgttaatgtctgggaaattgccagcagcattacgactacttgtgtggattagtgtaacggattcccccactaacattcaggaaatcatgtcaagcacagagtgcctatgtaagagtggttgtgtctattcactacatttcttggactaataacacacttagccttcctgaattgccaacatgtacaaaaccagattggggttttttagttgttcatggaactatcatttattgggtagctcctgtagaagcaagatacagaaactctaattaggaataagacagtccctgtacttcaaagagctctcaggggaggcacacaagtaaacaagcaattattatcatacgttaggataataccgtcatggtgataaccactgagtgatagccaaacacatggaagaggtacccaagtctaacttggggtagtcagagactgctttcaaggatatccgagtaagtgttagctaagacatgatacgtatttctaggagggaaattttcaaggcaaggtggagattgtgcagtgacgcccagagcctggattattttggtgactgctagtatttcagaatgacttcagcaaaagttgtagagaagatagaagacaacaaagtataagcagaggccagataatgaggacctggaacagtggtttgctggtaaatgtttaacaagaggctcttggcggggagagagagtgtctgatttgcagcatttggcaaattttgttgcacaaatgctccagcatagccaatttcaagctaccagtgtgacgtcattgaatgcagaattggaaagaaacgggcagtagcacagcattgtatagttattttcattacccagatataatagataaaatatccagatggtatttaatagatatggatgcaaaatttaaatatatgtacattcatgtgcttcatgttactgaatgcgcacaacattcattatccattcattcacgtgttaatttaacaaacatttctgagcctctgctctgtgccaaacgcagttctagctgctggaattacagcactgaaaaaaaaaatttgtcctcactgaggtaagacaaacattattatgcccattttacagctgagaaattaagacatatgaggattaagcagtatagttaaaatcacacaattggtacatgaaggaatcaaagaggaaatcagctctcagattttaaatccagggactcgtttctgctataccatactacctacctagttgagctggattttatcatggtttccctatttttatcaccatgtggttggataagtaaaataaatatatgtgacctttcaaataaatttgggtcatttttcttggaagctcatctggtgtgaactttaaaatactgcaattaataatgattataataccctggaactctgtagcaacctcttttgaagaactccaaggagcctctaaatgtatcaaactaagttcttcaagtgaattagttatcatctgagagtaatatagacttttaaaaatgcattaattgtattaaccctttcaggcccatagacttaagtgtttctttctccaaataaaaatagtaatctctgtccattttctttagagaataatgaagtaattttcattgaatatgtagtcaacataattacttcaattcaatcgtgaaggattttaaaaattatttatgtctactaacttaaagacatgcatagatttcaagaacttaaaaatgcatattgcctctttgccctatgcctcataaaacaaaattatgataacgttgtgtgttacagaaaaacgcactgattgtaatgaagggtgcttcaaaggccatgaacttggaaagcaacttatttacagagacccccagcaatagcagctaaaagattgactgactccctttattttcagttatccttcagacacttttgacctcttcctgtgcctttctagtcatgtgcaatcttgtggatatctcttccttcctcttgttattttctatttcctctgtttctatttgtttctaaaaataatcatgtttgaatataggattagcttccttcccatctccccattaccaatctctcactataccgctatgttattaatcttcctgagaaatatatcaggttcattacattagttaccagctcaaaacgtatcagtggctttctagtcctcacaggctcaagttaatctgcatattctgactttcatattctgggttcatgcaaacttttcaactttccctcttatacctacttaggaggaccctcaggttccatcatgctcatgtttcaagccagaagttctcctgcctcttcctctatgtagactccacatagactatgatatcctgcttctcttttaatcctccatcttcagctcacagccacactcctctgtgaacagttaaatgattctcccacctcttacctcctatagcacttatttttcatgcagcatttttgagacttaattaaatctacagttttaaaaaatgtttttctaccacagtctcttattcatactaaaactttcaagtctatccattttgcttatacaaccacaccgttaggtcttttaggtccaagaatacaagagaatggcaaagcacgttgtttacatccacacatactgtgtaaattcaggtaattttttttaatcctatgatcctcaattacctcacctgtaaaataggtactactcatactgcagaactcttgttggaattaaataaatgagtgtattaaaaatgctcaacaagatttggcacaaaatcggtactcagtaaatgctaatcattattccctttctcttcaaagctccacaattctgtattcatatcaccctctttatatcatttgcaaaaatgtatcctattccaactctttccacctagcctcaacatttacaaacactcctggtgggaagggaaagcttttgaggagagcacatctatactcatttacttctcagggatgcaagctgccctgcttactgagggcatatgttcatagtcacaccggagcccactgtccccttatactctcaaatgggcagtagcaaatcatcttgatcggtagtaatgacctgtctctaaattttcacatgcatcagataatttcttttttagtaagtgttatcttacatatatgccaaaatatcaccattatatggaacactagctgaaagaaaaattattcagtagtcttaattttctagctaacataaattctctccattttcatcatccatttagattaaagactttactgttagctgaatattcagagactttattctgatttttaaaatttatgaggttcataatgttaagacttcaagggtgagctgtttgtgtcatttataatgcgtgactagacagtaactagaaaatggattgttgactttacaagatttctccccaccacgtccccccaaacctgtgctgctgtgtatttggcctgaaatctttacttctagtcaatctttggacctaaagcctaccagcttttagcatcctttaagattgacgtgtctctgggagaccaatagatgctaaaccaaatttcgtatgcacttggcaatataggataataacaaccatactccctgcaattgtttcctaacacagatgtaacaaattaccacaagctgggtggcttaatagacatttattctctcacaaatctggaagctaggtgtccaaaatcaaggtcaattatccctctgaaggctctggggaagaattcttccttgcctcttccagcttctggtagccccaggtgttccttgatttcaagcagcacaagttcaacatctgctcctgacctcacataaccctcttctttgtgtgtctttctgtgtccactcttttctttattattattattattattattattattattattatactttaagttttagggtacatgtgcacaatgtgcaggttagttacatatgtatgcatgtgccatgctggtgtgctgcacccattagctcatcatttagcattaggtatatctcctaatgctatccctccccccctccccccaccccacaacagtccccagagtgtgatgttcccattcctgtgtccatgtgttctcattgttcaattcccacctgtgagtgagagtatgcagtgtttggttttttgttcttgcgatagtttactgagaatgatgatttccaatttcatccatgtctctacaaagaacatgaactcatcatttttttatggctgcatagtattccatggtgtatatgtgccacattttcttaatccagtctatcattgttggacatttgggttggttccaagtctttgctattgtgaatagtgccgcaaaaggacaccagtctttggatttagagcccaccctaaattcatggtgatgtcattttgaaattcttaactaattacatcttcaaagaccctatttccaaatctggtgacattcaaggtttcagggacatgtgactattcaggggaaactattcatcccaccacatcccccttgaaaattctggaaaatgtagtaataaaggcttctgataaattagtgtggaaagtattcacggttataaattactaaaaagtctcactgtgagctcttaatcaaaaggccctataaaacatttatttgcttgattaaaactacacatccgatattttggttttggatttattattatttttagacttggaataactattttatgtgaaatagattccataactgaagcagcatacctctcaatttcccaacatttattttattattttttgtcttcacactacttaataactgaggaaaaatcatttagaccaaagttcaccttggttgacaccatccagacagctacaggaaataacaatggaaactaaatctctaagaaaaagagtctttcatgtgaaatattgcagagttgattctagatatatagctgttggaagaatggatactattacatagatatggcagagtggtatccagcacctttcaacaaagatctttcagagtcagtcttattatgtctggagaatttacccagggcttaggtgcttttactgacaatctaaccacctgcaccccacccaccgtctaaagctaaagtttattggaagacttaggaaatcagtcttcggaatgtttctgagactggtacacccaccacttcattaaagtgcttcacttcacttcattagacaagaagtaaaatacttgtcaggaaattatttatagtaccatgtatatgggtatcttatttaatactacttaatgatggtactacaagttatataaaatggagaaataagtcatcaagtttgacaataatgatatttgatattatcattatcttttttattcgttcccacagaagtactctgttattggtttagaaaaatgatatttgatataataaagaaggaaaaggtggtaatattctttattttttgtatctttataccccagctctttcaccaatctcccccatctctgtagttctcctctggtgtccccaggcagtgaactattcccagtggttagggaacatctcattgagtaagttacatcaacatttcttcacatttcaggacaacaggaacagtgccaaatcctagcccattgttcaactctcaagccttattatcctaataacacatccatcccaagaaagaattcatcaagatcagagaggaatacgtataattttttatagtacagtatttaaaatgaaacagcttttggcccgcgtggtctcagtgggctcaagggggaaattcaggatgctagctcatctcacaccaagtttaataaagggtgtcctataaaaagctaatttcttgctggtaaattgctttttaagtaatccttgctgttgcaagagacccattcatagcgctgacactgggagccatgttggaaaggctagatatgctctgggagataaggtaagatccaggtggaatcttctctttacagaatgacaatgtatatagctaatattgtcctttgaggctagtttgcatgcagttgctggtatggcactgctcagcagcctgctgcagataagaatgagtgatgatgccctagattttaatggaacttttagagtgcatgcagcagtggggtgcagtcttcagcaaagaaaaacgagctgacttgcaggcatgagagatcatcaagaaagataaagaaataggacatccactctaggttaggcaaggctttttagaggatattatggaaatgagcaagaaccaatttaatttttataatgccactccatttaactttaaaatacaaggtcaaggtactgtgtttttcataatgattaaagatttggagcactctttctgttgaaacatactgcatctgtttggcagaaaaaaaaagtgacaaagaataaaactgggatcagagaacaacaaaaacatattctgtcacttgcctaacacaagttaaaaagcaaaggaaaaagagacaactctgatggacatgttcatccttatcccaacagaaggatttatttacctaaggtcctattatttcaagttactttgatcccaggatggtaacataaaatgtacattttaaaataaaatggaagtataagatcaataaaaaccacatatctgtggataaaacagcagattcaatcttgtggctgaaagtttgctttaacccaacatttggtaaactattcactctgtaatttattaaaagacatactgttattataaaactatctcagtttgcatcttgttggttctgtcaaaatttcatcctgctaattctcaacttgtaatatctctgatatacatgattaatctattttaggaataaaacaaaaactacctttatcttacgcatttctaggaagtgtttttagatgtaaagtaggggtaattgtagtatagtggaaaggattttgaacttgaagccagaacatatgtctctgccaaaaactaggtgtgtgaccttaaataagttacttagcttcctgaatcttagtttgtttagcttttttctataaagtggcacacctatccacatcacagttttgttgtcaaaattaaataaaatactatattagaaagaaacttttagaaagaaatttataaactgaaatgtactatacaagtttaaatcattctcattattttcttaccctaaaattttgaccttatttttcttagcaaatggctgaatctgtaaaatttaacccccacgcagcatctggattcaagagaactacggtcatttctttatacagaatactaattatacacatatagcaaaacacaagttttttccaactactctgtgtttttaaagattcagtgtgggcagaaggaattttatcaactatgttaggggaaaaaagtctgaagaaatgaaaataatgagaaaaagcactgttgatttaagtgcaggaacataaaacttcaaggcaaatgtgaggccaactgagttcatatatatcctcacaaaatgatttagttaatttaaaaacttttctaataagcaacacaggtaatcccaaattctatcttttatagctctaagagtccccataatttattcagcaattatttaccacccacttattataagaaaagccctgggataagtcttgagaagaaactaacaaaaacaaaacttgattgtttgctctcaaaaagctgggtctaaaataggcaaggtaagattttgttttgaggagcccgtattttccagcactgtccattgtaacattaaaatagtttgccaaaatcctcactctgtgggtgtatttgcctagggtgctaaaattgcttaaaaactttgttatttggctaactaaaatcactgaatagtaaacagtagcattagagatggcagagacattaggtgtcatgcagttcaactgcttcacctagcagacaaagacattaagttccatttcttaaatttaactatctggttgaggatacacagtagcagagctaaatcaagaacctcttggggttagagtttttgtttatgcattactttgttttggaattaaaaacagtgcctgtttgctaagttaaattgaaaatatgctctgaaggagaaaaacagctataaaaatagacttaacttccaaactatggatcacaataaactaaagaaataatttctgtagcaataaactccaacactttccataggaccagaaaggcttgagaaagaggagaacaaaaaaatgctttggggcttaccatatatatggagaaagctaaatgaataaaccagttgaaagacagcgagttatactagtaacaatattactgatatcggagctctcacttataaattgtatattatgatcatagtgactaggtactttatatctgctttctcattccttcctcacattaattcacatgtaggacagattacctcttctgtttctatccagaggcctagagctcaggccctcatcgaagacagacagagctatcatccttattctaaaaaaaaactaagaccccagacatagctgtgctacttatagactagaatgtgagagaaaaagacaagctttcatcatgggcttaacaaactgaaacacttcttcaattttgagattgagaaacttagctaatgctaggtgtaaagatgatatgctaccttcataaccttggtgaggagaaattagcatttctctcagtcctagaaggaggatgaccatgaaggtcttcattctcttgagaagataatcaaatgcttcactgccctgttaacggtttactcaatattcaccaagaaaagtagatgggattatttttgcagacacttatacgggtaatttattctgataagcagagacatacctttagtgcataaattgttccctttgtgctctttgtaataaacatcaccatagagaacaaacacgaagtaatgacattgaattaaaagacaccatagaggcaacagcgactggaatttgtgaaagtaaaaggatagtgcaaacagttgtgcgttgcattctgctctgaagattaacaagctgggtcaggctttgaccatcatgatgagcaggagatttttctaatggaaatccccaatcaagttcctgctgcacccagaaaggaacggcttacagaaatcttacatttctttgcacataccaaattgcttggcatattctatcacaaggtttactttccagggaatgtgatcaagaaatcatgatcctaattcctagttaaccctcaaagtttctcagaacagtcagtgcatcactgtcaacttttgtgcaatgtggaaatcagaattggtcacacgtttttccggccactgttttagattcatataatattagtgaaatcatgtcagactggtatagccatgaatttatacttcatgaataggcactcaataaatagtggattaaatcgaccgatttgatttttacctccaataatttcaaaaatatcattgaagacaaggttgttgaagctgtcacttttcttgctgaacctttgttgtgccaggaggaacagatggtaaaatcaaaagtgattagagaatcagtggggtgggggtgagattggaggggagaggtcttcccagtgagacccgctagcgtcttccctgagcagtatgttaacccaagacaattttagaaatctgtgcccctaagttgcttgacatccaaagcacacttgatgcatcctacatttctaaatatttttattgttgtttctcggtagtaatcatctggtttagtcactctaaaagtcaaggatgaaattttaaaatgcaaataaaagtgcctactttctctctttccaattcctttttgttttattgaggtataatttacatgcacaaaaaaatcgcctttttaaagtgtacagtttgatgagttttgacaaacatatgcagtcctacaaccacgtccgtgatcagaataggaaatatttttatcacttcaaaaagtttccttgtactcccgttgcagtcagtctcctgccccaccccagcccctggaaaccactgataggtaaaagcacttttaatctgaaaggtatttaatgtatggcagtgtcagtggtaataataacaagatttattcattggttcactgtatttttgagcacttatatgtgcccgttgtatgcaacccattatgctcaacccctgccctcctcaccagggataaactagtggcagagatagacaaagaagccgtctctctatcacccctatcttatagaacattcttcaatgttagaaatgcagtataatgtggccattgagaacttgaaatgtgcttagtgggaatgaagaactgaagttttaactttatttaatttcaattaatttaaatttatatagccacatgtggctaatgactatcccactggaaagtacagcttctatacaatatgataatatgatacattataacgcaggagtttaaccaagtgctaaagctttactatcaccagggtcactggtgttatgtgaaaagaaaacttacaatagaaaaataaatcctttaaatagtcacagacctgagaaagtttccttctcaagggaacacacattggctcattcaaaggaggttaaaaactagcatttaaggtaatttcatgaagctttcctttggatttctcatgcttattgtatacataaataggcaattttcgatgggacctaataaatcactgttttttatttgaacattttaacaaaattatcaaacagcattgcatttatgttcaacctatttgttctgagaaagacaacgattaagtagaagtcatcaaagttaccagaacaatttttgttcttatgttttagaaggcattgaaggtgtttaaaatgtacacttatagagtcagagtactatgcaactgtggcccttatagtttatccgtcatgcatctaaagccattgttacatctgtttctaattgtgcatggattgtccaagatacacaattggaaattccattttatttatcaatttgaagaggtttcacccatgtggtcactatgatcactatggagtcacattaaattgagaagtctccagaagttgcagtatttatttaaaattctaactttcttcagaggaacaaattctccatttctggattctgaatcctcattagccataaggttgttgtaagaatttgcagctaataggaacacatcctggggagagaccagttgaaaagtaacttggttctgagtgaaattatacagagacagtttctacttcaggtggtgttgctaatgaagctatcatggtaattttagcccatatgatccctaaacgacttcagaaccacttttcatccactaagaacccacttcaaccactgccacgttcactaccacagtataatatggaacaccctctggaattcagtaagtaacttcttaactcattggctatagagctttgcctttgtaaattctttccttttgcagtaaaagagattgtttcaaagtaatccaattagtccctaggcatgtctagaaaggtagagtcaacaacagtaaggtaatagtccttataagatatgtaagaaattatcagtcatttactttaaaataatttgtacacttttccttttatatggttcttctatgttgaagccagtggtcatccagtgattaagattagccaaactcaaaaggctaaaactaaattcaaatggtattattttgctttaattttatgcaatgctatgtatttaaatttcatgaaagtttcgtatggcattgctatcaatttcagtcaggataaatttcccgtgaaataatccacaattttcaactgtacgttgggtacaggtaaggaaacacccttaagagcttatccagttattagctggtattataaatttcaagtaattcaatgttcaattaataaacagttactttaaatgggaaagtatgagtcaagagttagtacaaaggagaatcttaaaagatgaacatcaaagaatcttactattgatttgttggtgcctttgcttgcacttctccaaattgacttgacgttttaaatttgtactgataatcatcagagtcaaatctgcttttaggcaaaaagtatccgctagttattcccctactatgaaagtgatgagatgaattgatcatgtctccagtgtatggatggatgtctttgaggaagacctactgaccttatgtttatcttctgtcagcatggtgtgactatgtggagagacagtgctatttgctaaatactttgtttttcaaataaaaagatttcacagattatgcattgtagaatttataagtattcttttatgtctttgaatgtgccaatacaatttttatgaagttggaactattttatctattttaatgaaattgtaagccttctgtgaattcttttattaattttattctgaagaaaatctgaccaggttagggaaatcaggtcaggttacgacgtgatcccagtggaaaagctgaactgtggactgtgatttaaaatagggaagaggtactgaagtgttgtttttatttttgtttacaaatcagcctttctaactattatgtactcccatccttctatctttttctccaccagaacgtattaacaggcatgcatataattaatgcttttcttgagataatattaaaattaacttcatctgtcaggccgtctgggctaaaagtacacagtcagatctgggtaacatttgagttgatgtaaatatgcccacacatactgacaatgcttaccatttattgtgtgaatgaaaagcagtgtaaatattgtttgttctactagggaagctccacattttaatcaaactttgaccgtatttctaaaatgccagagcatctggaattgttaaaggaactgatagtttttgtgtttttaactgttaggatacttgaaatccaaagggtaaagaaactcagctgatttatacgtttcttcctctttattttaatgtgataaaatgtagtttttgtcatgggctgacaaacagtggtagactacactaactctgcgtttgctgggtttaatcttaccctctcaaggcatggaatgggagctcacttcagacccagccatgcttcactgtccactgccttctcatggatatagtgtgaacattaattagatgaattccataaagtgctttaagctctttggagaaagatactcgctgcataattattcttaactcccatacgctcttatgatataaaccattctgccaggaaatcctttttagggattatcacttaaaatgaaattttcattattaaaagcaggaagaatatacatctactgacagacgaaaatgtgcttaaggcgactgcttttaaataggcagaaatcctgaactatggagccatccatgcctgaaaatactgagtaataatgaaaactggtagcaaatttggaatattaatcatcacattaagttgcaaagaaaaaaaaatacaagccacatgccctttaaaaatacgtgcacaaatctttattctagaaatatataactttaggcctaaaaaagtacaaaaagtaaattattttatggctctgaaagtatccttaatttactcaggtgacaacaattagtgtttaaagagttagttttcaatcttagctacaagttggaattactctggaagctctaaaaaaacaaaaaacaaaaaaaaatagagatgcctagttcccacctgcagaaattctgatttgatttttctggtgcgagacctgagaataggaatttttttaaagcttccctagtgattctagtgtgccacctaggttgccttaaggtaaacctcatattatgcagaacctagcaatcacctatcctgattttatagacgaagatcataagacccaagagggcaaattgatttattcaagattgaatatacaaatgatagaagattcacataagatgcagtatacagagtggcttgtggattcttgccaatgcaggcagcagaattttctttagggttcacccagttcaggcacctctttgcagcagcacttgactaaggttcttctgattggatcattatatgggcaaaaagaaaaagcttaattgaaaagagctgaacccacattgtggaatggaagatatacagtttacacgttataaatgattaatattcatgaaagcatactgccctttcctcttcccttcccatagatgacatcattgcattggtgtagttaggttggtggtttcttgttgttgatcttggttctgacacagttcatcacttattatcctggcttattatctacttctacattcattgttcactcactcactaattaattcaacatggtttttattgttttggaccggttatatgcctgcaacgctacgtaaggctgaggatattacaatgaacaggaaacaaccctgaagtttaaggtatcaagcctttgagttactgtcttttatcatagctgatataaaattgaagccccactttttttgttttcaattactgaaaattcagtgctaaaaaaatgtggatttttattcaactagataaagtactacaattaggtttccactgaccttggctgtttttgttcccagttgccattacataaatctgtgccactcacaacttaggaagggtgtaacattctctgtaatagtttgcctttcgaatagtgtttggattcattactgtccctcgcagtttggaataatgaccactgaataatcagtgtttggagactaaattagtgctgcaaaattccctcaaattacctactgttcttttccctgtcgatgtatcctcatattcactatgattaccctgagaagaaagatattgttgagaaccactttacctactcgaagttttggtatttcaaagattcatacttatgtcatgttgattacattagcactaatactattggcagaattctaattcacgttattttctttttttccaatttctctccatgcctatgtgttgtcccttcgcagctataaagccatggccgattcatgggtgcttttgttaaggcgttcagcagtcacgtttgtagatttttgaatgggacttagagcccttttttgttctttatgtatttctctatttctcagcaaaggaaatgcagacatgcaagaaatagtgatcaaatgtcctgtgtactattgtgggtgtcattaatggtatagggagaaatagaaaatagttgcaaagatgcatttaacaaataaacgaggtcttgagattcaccatgaatgtggccccttctatgaaaagtagttaacatccaactgcaaagttgtactggatcagtttgactttaacctttagctaatatgaaaatatggaattgtgtggtggtgctcacaaaaaagaaaactcatttttcttaattatcatcaattaacatgtactgactacccatgagggaaagttaatttgctcttgagtggaaccagttatttgccctattatttctcccttgcttattcccctctccctccctcctccctttccattcaacaaagaaaaatagataaagcaatttctgattagccagtgaaagcctctaacataaaatttccaaagatgtgccataaattatccacaaaatgtaaaacttttcaattttggtttgcattttcttttttcttattataaaggtaataagtgctcattatagaatttgaaaaatataggaagttgcacggaagacgaataaaatcagccataatcctacaaacctattgacacttgtacatatgtttgttatctctaatgcattcattatgataatgcatcttttcaaccaatagagtaatcactggtgactttcaaatttgcctactcatttttcactctgtggacttactttactacctcttgccctttttcagtaaatgaataaatatttaagtaagtaaatacaaatgtaataacttatgcgctcaagcacacagatacacacagagagaatttggaacttcggaaatgccatcctctccctagggccgcaagtgagttgataagcacgtaaggaaggataatcaggggagccttctcgtattgcccagatggctcaaaattcgtcatctctaccaaacaactatttggagctttgaagaaatatccatgacccctttgaattcttcagtttctttcgcgttcactttgagaaccaagtgacaagtgaatttcctgacttggtcttttaaacctgttagcgcagttccattgagattttgtgggcacaagattgcaatgaagagatcaacagggagaaattcatttccctatatatgtgcgattaatccggagtgctaagggcagatataaagcaggtgcctactcctgtataacttggaataaaaccatttccaaaggctgatgatcctcaagtcttgttctgcaaatgactgatgtataacttcaggccaatttttctccagttagtctgtgtcactgggagtcccatttctcggggagcagccccatgctttgtcaggtgcggagcccacagaaggttaatgcgaaaagaaggcctcttgccagactgttttccagatgatacgtagggttattagtttgagctccttaagaagatttttctcacctgtcctaccaacttatgtttatttcattggtgttagagggtttcagtggcggaagtaaaatatttagcggggaagggacagcgttcatgggaattttgcctaacttaattttgtatctttagctcattcgtagtcattgtactttgtgttttgtcaactgaattttgtttgcatacaaaggcacaaaatgtttgcttcagacctgtcactcttatttttagcatggttagacaaaaactgagatgctttaattgtctaacttatcccagtttaagtgctgcaaaatctcccaggcaatgtcatgggcaactaagggataaaatcagagatttaaaggtgccaggtttcccacgcttctaacagttggcgttttgggtgtatacaatccctcagctttcttctttagtttatggagtcttgtggagggaatagcaggtttttagctaaaattatcatgctgtcgagttgggtctctagtgcatcctgaagagcttgcattatttacagaggctgggctatcattttaaatcctgatgcttcaatgcccgttatcattcttgacaaactcttccagcccgtggtctgttttcctctgtttgcttccatttactttcctgagcaaccagctgagcaaagatttacataacttttgtttaaacaaaccctgtacagttcactctttcagccagtatgtaaacacttttgagacacagttacatttttctattttagtcccagattctgtttatttgctacattttttgtgcccacatttttgtctttgttaagtctcttacagattcacatgaaaaaccagaaaccgtggctgctcaaaagtcattaataatgagatttttagctactgtttctgcttgtaaattcttcatttcacataatacagtctcaaaaggccacagagaattcagcctcgcttatctctgtgttgcagatgatggcttctagccttacccaatcccagtgcagcttgcttgccatccaggagtcgaatttgtttccatctgacattagcgtattaaaaagattggagatcaacaagcaacaatgttcttgtagaaaggtaatcaaggtttagagcctgtgtgtcatgagactcctagcatttgaaaccgctaaggggttgaccaccattgtcccaagcacctgtttaagattctttcctatgataagggacctaaagtgattagcatactgataagattttcctagaataacctatttatttcagtattattctttcaaatcttaattaccatcttttcctttacccagggtcttctttctacctctacgacacatttaattacctatattccccaacctgtaccatattaaattttgaatggaagttttatagggtaatttattggaaggatggccttgagtgtcattatgttcaatgaatgccctattttgacaaagagatgactaaatgttattgaaatctttttaatccaccacgcttctgcttagatgtaaatgcaaatctgttctttacatttgtgattgaattgaacttgaaaagtaccgccatattgattccttctgcaaataaaatataattacatttccctaaactttctacactctcccaagagattggctggctttgtattgtagatttttggtgatcacagaggacaatgcattatcataagaccaataagatttatttttaccttggtaaagaattttaatttatttctagtttcattttcatttatatccatctcttctcaccctctgctctacaaaagtatatatgactatataaattgaaaaaaatatcaagtgcaaaattacagaaataaataattaggttattttagtggaggaaggtttgttgtgggtggaggaggagaggagtgagccaagaaaaacgagggaccatacgtgatcatatttttgcagctattttaaattgtttgtgtatatactttaaaatattataaaataaaattttaagtgcaatgcatatttggagccaatgatgagggataacttcagaaacgtagcatcatcatctagtgctttcatagtcctttcaacatttccagatagttttaatggcctgctcatggaggcaatgccctaattttaacatatctcttcacaactctgatttcttgcttcctaacattaaatgtcttcaaagcttctttcaccactaattccttatcaagaggataagccagtttattctttaagaaaaactagctacacaaaaccgtaagtcattccaacataaatccttcactatcctctctctatagatttggttttgattcctcctgctgaaattcaaccttctttcttcagctatccacacgtcttaccctctaacttccctcaggagtgtctattagctcccattacagtgaccacagtaatatagtaatcccctgctgttctcactctccacttccttacactgcgttttaagtctcttcatattctttatcaccttgtatcatgcatcggttttcttagttgtttattttatgttgccttcataaattccatgagagctcactgccgtatctttagaacatggaacagtgcttggaacataatgggcattccttaaatagctgtagaataaactttcaaaatcaacaataatgtatttgccaaatccattggcttctctgccattttatcttgttcaataccactgcgatattccccttcctttttttttttttttaaagtctgtaaccctttagcttctgtaatattcctagttttttattcctctcatgtgtcaaaatcatcagttgaggcttattgttttctctttctcactctgacctcacctttgtttacatctcatcttctggctttggctatcctgttttttatctctgttccaacctgtatttctagccctactacctggacatgacatgtggatatctccgtatgaccgcagtttccatatgactttgcaaattcatccctgctctcccctccaaagtcatccccacaattgacttcctgttccttccaacctattaaggttcaaacccacttttgctcctcctttgcaggctacacttttccttctcagtacctcttttttttccaagttcttagataaaagtcatagtaccttacgttgtaattgccactggtctggtctttctgcctgctttcctttccatttgtaatcacattatccattccaatccatttataatactgtgatcagccataaaaataacatttatcatatcgtttgtctccttaaaacctgtagtagatcccctctatttacaagatctggtataaaatcacccttcctgatattcaatgcctgttttaatataatctcaatattatgcgtcataaatccccctgtgttcttgcactttttatttcttatacatctcatcaaccatgtcttatcaactctcaaaacctgtattggttttcaggaaaactcataaattattcttttgtagaccttttgtttgtcatctttgaagatctctctctgaactacaatattttgtctgtataatcaatttggaaattcatcaggtattgaaatatgacatgtcttctattgtcttgaacattaattaaaactttatttgactttttatatgcttacatcttgtttcctcacggagtgttaacctactagaaagtaatagtttaatcttatatttattttaattcagatttagtagcatactttacacgtggtaggatgtgtaactgccttacaccttgcttacgtgagttattaatgttttcgtatatttaatctgaggatgtactagcaatgttaaaactgtaccgcatgaaattgagtaattgaactatttgttttaaatgtgttgcttaacttattgtaccattttctcataatcacagctcaagttaactttgtggttgtacgtattatttcttgtgaaatgccaacaaacttagagcaaggaaaataacaggtataatcatactataaaggcaaccttaacactagcatagtctcttagctcatatggtaactacaataatgtacagtgacaaagagaatattgtactttcttagcacacactttcctactactctactgttgtggataaaaacagacatactttaggagaaactatgttatttccaaataatgccttaaaggttactccaggaaaaggcatttacataaactatctaggaaaagaaccttttaaataatataaagagctcacccaaaaggactgaagtgtttagttgaaaaaaagtaaaaatgtcgaagactttgaaaaatagtttcttgcagtatattttcatcgcttccacttacgttatgaagacattaagcgctagtttatcaaaaactatttttgtacatgtcttctaatgacagaacaatgtcaacatgattttcatcattgagaatgcgtaaagaaaccctttgtacagttttttctatgaatgttcccctaagattaaagcaaatttccaacacgaattaggcactccgaaaggaggaggggagggaggggagcaagtgctgcaaaacttcctgttgggtactatgttcactatctgggtgatggaatcaacagaagcccaaacctcagcatcacgcagtatacccttgtaacaaaccaacacatgtacccctgagtctacattaaaaatagagattaaaaaaaggaaatcagtatataatctaataaatacctctcaagctttctcatttttaaaataaaattttagattattattttaggaataaaataggctcttcattgtatataagttcatttctgagttgcaaaaatcctctctttatgtttttttccccgtattagcatgtttttctcctgtttttccccactcaacttggctgccacaatcagaaagcacaaagacaattttttcttgcgcttgtaaatcaaaaccttagcatcagacaaaataactgctccaggtctgtcaaatagattcatttgagctttcttcatgcattgaatacggcagaatttctgacctgaagaaatctagccttttccaaatttgctttaagaacattttgcaataaatttaatataataaaaggaaaaaacacatcaggctagaatttggaaccgattgttattaaaaatctcaagtctatcaatttaacttcaacaaattacttaatttctgtgatggttaatttcatgtgtcaacttggctgggccgcagggtaccgagacatttggtcaaacattattctgggtgtgtttatgaggctgtttctggagagattcacatttgaatcagtagagggagcaaagccgattgttctcccttgtgtgggtgggtctgatccaatcaattgaggacctaagtccaatcgattgaagacctaatcaaaaagcctgattaaaaggaactcctgcctgatagctaaagctggaacacccatcttttcctgcctttgagcttgaattgaaaccttgggtcttcttgagtcttaagcctccagttctggggctggaacttaacgtcattggctttcttggttctcatgcctttggactcagacaggaactacatcattggctttcctgggtctccagcttgctgactgtaaatcttgggacttctccagattcgtaatgagccaatttattacaataagtctctccctctctggtttcgagagagagagagagagagacagagagagaaatgagagcacaagaacgtgagtgtgagagtgccctaatataatttctctaaatatcactggttactcttcaaagttataaaattggtataaaaggtgacctcaatttttcatggagttaatgtatgaaagtcacaattaaaaaggaagaattagttctggtgtcctgaaagttatttgaataaattaatatgctatggaggctttaaaatactatgaaaatttaatattgtattattcttagtgttgctatttttaaatagcactttttcttttcctttttttttttttttttttttttttttgagatggagtctcactctgttgcccaggctggagtgcagtggcatgatctcggctcactgcaagctccactgcccgggttcacgccattctcctgcctcagcctcccaagtagctgggactacaggcggccgccaccacgtccgggtaattttttgtatttttttagtagagacggagtttcaccgtgttagccaggttgttctcgatctcctgacctcatgatccacccaccttggcctcccaaagtgctgggattacaggcatgagccaccatgcccggcttaaatagcactttttcttgtgagtcactttttaaatatttgtgcaaaccttgttgccattctactcaagctaatatcctaaaccgaggacattataacatttcaggagtcaaaacttcagacacttaacatagtatcctcaggttcatccatgttgtcataaatgacaggattttattcttttatatgactcaataatatcccattgcatatatatgcaatattttctttattcatccattattaaacacttaagttgattctatatcttggctattgtgaataatgctgcaataaacatgggaatgcagatatctctatgacatactgattttatttgctttgtctctgtccccagtagtggaattgctgtatcgtatggtagttctatttttaagttttcgaggaacctccataccgtcctccataatggatgtactcatttacattcccaccaacagtgcataagggttcccttttctccatattcttgccaacactttttatcttttgtattttgataatagccattctaactggaatgagatgatatctcattgtggttttgatttgcattttcctgatagtgatgttgaacattttttcatatgttgtattaactaagccaaacacagaaagacaaatgcagcttgttctcattcatatgcacaatctaaaaacatcgatctcatagaagcagtaaatggacggtggtcaccaaagaatgggggaagtaggggaaaagcgagaatggggagaggattgtcaatgggtacaaagtcacgattagaaaggaagaattagttctggtgtcctgttgcatagtatggagactattgtcaacagtaaggtattgcgtatctcaaaacggctagaagagagggttttgaaggtttctaccccaaataaatggtaaatgtttgaggtgatatgctaattttcttgatttgatcaagtaaaggtcttaattgtttggcaattaagactcatgaatacaaataaaggtcttaattatttggcaaagcatgctgagttttgtaaacaattcagtagtgatttttgagaataggtcaatagcaaatattaattaaaatgtcttctatttatgacctacagctagatggtaaacagatagatgatagatagataactgatagataactaatagatgacagataaatgataaatagataaatatagataatcgagagagaatacctttcccttcacacacgtgcatataggcacactccatttctatcatagttaccaggattcagacattttgtctcactatttttctcaatgtgaacatgcatataggaatattatagtttttgttctgtgcccattttagttcgttttttaatatttcaggacaaaggcaatatggcggtttcactttgtttttcatttttgcttatactttttaaagctcagtgtagaaaagtttgaaaatacacaaaagtattaaattaagacagctgggcacagtggctcacgcctgtaatcccagcacttcgggaggccaaggtgggtggatcacgaggtcaagagatcgacaccatcctggccaacatggtgaatcccgtctctactaaaaatacaaaaattagctgagcatggtggtgtgtgcctgtagtcccagctactcgggaggctgaggcaggagaatcgcttgaacccgggaggcagaggttgcagtgagccgggatcacaccactgtattccagcctggtgacagagcgagactctgtctcagaaaaaaaacaaaacaaacaaacaaaaaagcacctatagtctttctcccataggttgccttcttaatgggttttacaccttttgatgttttcttgagttctgtcccattagcaagtagtattgtacaaaaaaaattttatcatcttttatttaatattttattgatgtttaataattagaattattttaaattttatatgtcattttaaaatgcaatacaatatagtaaactcccagatgtgattgtaaataattaattattctcccattattgggcattgggactgcttccacattttggtcactgcagtgaacatccttgtacatgaatctgtatgttgaagttgatttcattccacactccccttcattcaaggggctccaaccattctcgttttctttcagcttctttatatccaggcatataaagttccttcctgactcgggagcgtcatacatgctgttttctccatctggataagtagttaattctgttcttctttgtgcatctcccgtttcagtaacttcatctccaaagcctttccaggtcactttatctaaagttacaccataatcttgcaaatcctcaactattgagcattattagtctccgttatcattattctccattattctctgtgaaagcatcccgtgattttcttttgtccctattaccacaatatgtgtttattccgtgtatgtacatctttgtttgtttattgtttgtctatacctgcaatgaaatgcctaaggtcaggaactgtctgatgcaggatgcaatgcgctcaataaatatttactgaacaaattaattcatttgctcagtcttgcaggcaaatggtacttctgtatatttaaatatctaaaatgaaagcgttactcgttactgttggttgtcaatcaaaatttaaatgtcgatgtttaagcgtgaaagacctctgtcaagttaatctgtacttacccaaaggctattatgtagaagcgacataaatattttcctaaatgttgattttcatattttaagaagacaatgaatgtttcaaagcattttcttctacacagctatttattctggagagtggggcatatgtttcttaatattgttaaaattggcaaggggatactgttgctatatacaaagaacacctaatcatcatgcagacgttttgtttctggctctcagttatgaaaagcagagattttaaaaagttacctttatatgctaaattaggaatggcagaaggtaatattctaatgtttataagtggttcttctctgagtccttggtttctatgtttatgaattctctttttgaaagaaattatagttattattaccaggtctattcttttacattgtttctaattctatggtgatcttcaaaatagagtatcaattttaaatacttgggaatgaaattattcttcccatatcatttctttgtatggcatacattgtgatttgttgtcccatcattgtttcagtatgacctgttactgcaaaaacatattgagataaatcatcccacatactctcggccaggacagacatcacactgttgcagcaacacttcagatgagccccattcaaccttgtgtttttatagagaaggatgccacatgtttatattcatttctgaagattggctcatattatttattgaaacatactagtttaaaaatctgtccatttatataacacctggtctatctacataacttgaattacataaatataaaactaaacttcccctcttctccagtgtatagcttgcaagcaagtgcatgtgaaataaattaaagccttgtttgtgtttttttcatcatgtgagtacaagacttttcaataaaaatgaattacttttgaacatatttgtttggacaacaaacaagagaaaagatctatttgattgatagtggacagaattttcattaagttcaacagcagaaataccacaattgcatcattcaccttcgtgtatcaaaagaaaacagaaaattagatgtgatgaactctacacaaatgttcactatgcatactttacccattaaatacattatcaagaatcatgtcagcatgacattctaatatagcagctttacaaaaacatgtaatctaatctagggatgctgttgtcctctttaaatcagcttcaaacatattctgggttgatatttctcattcttttttgatccacattgtttattcacataatgattatatttaactgaagataacagcattatcaaagtgaaagacaaaatagatgtttaataggaaagtgagtatcgaatcatcttttttctaccaaaaacatctataattatgaagtatttggttaattattttcacaataatttaaaagtgtacaacttgccgatttttttgtactttctacttttcatgtctcgcatatatctctttaatatctaagtatttgagtcagaaaagagccagtaccgaataatgggaatctcactgaaatgtgataacaatctggggcctggtcctgggacctttatctgcaggacaacttggacaaatatttagacccccaattcctcgtctttaccctaggaataataacacatttttctgacctcatacttcacgtggatctcaaatggaacaatcatctgatagcactttatgaagtatatgaaagcaataaattatcacaataagataattgcaattattctttggcatagtattagtgatgtctttatctgtctgacaaaatcaacatttctgtatggtaactgcctttccttgttttaacagaagatcatgccagaaaagatgagtaggtagatacttaacttgttgttcctgaatctggaatgtattgcagatgtcccagactgatctttgttcttttttttccttacaaatttcttttcacattgacagtgtgatatttctttaaatgtgcaatacatagctaaccttatttgtttgtgtttactaattaaaatatctaaactgcttaaaggagaaaattcagttttaagttttattgatttatacccttcttcaatccacataggattagggtagtatgtaacaaaatttcaaactataaatgaaatattgagttttgtattaaggccaaggatgaggaaaaaaaaagtaagtatatatggaaaaagaatggtattgaatgggagttttgatggagcatgttgacatcatgataatacctattatctttatattctgaatgtcagaacaaaattagagcaattttcccttatttccctacaatacgtctgtcttaataattctaagctttcctgatttcagtagtaatctgtattttgcaaaaggcagcatgtttataagatatcaagtaaactaagtttatggaacttgtaacagcatttttaacaacatttctccctagatagttcatggtagacatgaatttattcaaaactagtatgtagaaaaataccattaacaaaagctctgaaattatattagaggagctgaataatgttacttgagaaagaataaaatgttatttatgatttttggtatcttttacccactatatatggccatatctctgaaaaactttagtaatatgtactaatgcaaatatggtagtaaattatgtctacaggtgctgataccatagtagataaagtatgataactttattttaaaatatcatatttaaataattaatatacagtactgggaaagactattttatctattctctcactcttgaataaaaaaatccagaaaaaaataccttgttttggtaagattatatcaatttatttcccaaatgggtagagggttatttttttctgatcataaacgtatgtctcttcattataaaaatccactaaaagtgatagaagaaaaccaaaagaataaatgtaaacaatgatgccattttccaaaaatcaccttcgacatttttctggatattgatacagtctaaatctcttttcggaagactccctcctgtgtaggttccccaactactctgcaatcttatttcctcttgttctgttcttgtagaaaggagacccattgtcaccatgtcaaataacacaaaatggtgcacgtataagatcattgtctctgtccattatttgccagaggacctcaaactttttcaggtggtgggcaactggatgtcatgctgctccttgtacaacagaacacaattcattatttatatggttatttcattttaagaaaatttaactttcattagctggaaaaaaaaagaagtggtttttaagttgtttagaaatgtgaaattcaattttcatactgcaaaagagattcaactgcaaacacaggcacacatgtctggtgtaagaacgagttgtcatacaaacccaaattagctgcctccacgttgtctttgttaacaagtgtttgtttgctccttgttccatcattcagaaatgctctttagcaggaattgatggaacacagtcgcagtgacctcttcctgtctttaaaaatcgagatgacatttgcccatctgcagtgttaacatagttcctcaaagaccactgacagtggggtaggactgtattgcgcaagttctctcatttccctagaatataattggtccagggccagagattttagctcatttagagcagcaaggtgctcttttaaaattccctcacctattttgggcttcatttcccttatacggttatgccttttccagtctgatgaacattctccttgacagagcagacaagcaaaaggagctgcacactgctgctttctgtgtcgtctctatccctaaccttctcccttctgccccaatcagtgaaccttcgtctttctggttcttcttcctccaaatggaagtaaaaaggccctgaatgttgtctttaccattatcacgagcctcaattcattccaagctcagcttttcctcactgtttatacagttctatattgttcttctaatatttgccctcagttctctgtccctcgtttcttcccatgttcatactctattagaatctgagcacctttgaggttgtccatacagtggcacacatctttgttttatactcactgggatgatttgccattatattgtcaaaattttattctaaagagcttttacaggctttcttgagccattttctcttgaaattcaagatcgttgaatctctacgctttttccttcttaatctaataaacatacacccccacatacacacgtgtgttcctgaaagacagatgccacttgactcgtcttatagattgtctaaattgatcattgtgtgtggggataaaagggtgaattgtataatatccctgatggttcacgaagtctgttcctgtataacctgattagtcttctgaactcttttaaattctgtctgcaaatgactgaggtttggcaatcagcctatttcagttagttgttttcttgcataagaagggtccatatgtactgtgtgaagtaagagagagaaagtacttagatttgctggatgccctgattgttagcatggctaaggtattgtgtaagtaaggagagcagttaaaaatgatattgtttttatttcttaattgaggtaaaattttatataagatgaaacagacttatttgggagaggaggaagagtttgttcttacataacatttcaacctgtcatatttagttgagaacttcaatctgtcaagatactttgtataatattcagattctgccatctaatatattttccacgctttcttactgggtgtgacagtaacttatactgtggcaggtgtataagttagtaaagatattaaatgctcaatctgttaacttttgtgaagtggtcccactgataaagtgacacctcaataaaataaaaatttccattacctcagaaagctttttcatgctaccttccagtcaattcccagccccaataggcacctattcttctgatttatatcaccatagattagttttgtctttttaaaaatttgtataaatgaaatcatacaaaatgtactattttgatcagcatactacttttgagattcatccatgtaagtgtatcagctgttcattcctttattgatgattaatattctattgtatagatataccacaatttatttatctattctccttttgatggacattcaggtggttttcagtttttggctgttatgaataagatgctgtggacatttgtgtacaagccatttgtgagcatatgttttcatttagtttgagtaactctgtagaagtggaatggctgggtgaaatgtttaaatttatgagatattgtcaaacagcacctaaacagttttctaaagtggttgtgccattttgcaatgccaccagtgatgatggagagttccagttactctacatctttgtcaatatttggtcttgtcagtcattttaatttttgctatcttacagaatatgtaggtatattgttgtggttttaacttatattcctctgattactagcactattaagcatcttttcatggatttattggacattcatatagattatgtgtgttgaagattattacctttatgattattgggtgaaaatagtatcattttgaggtcattcatataacttgaagactgggaatgacagacattttcctgttttgtttcttttctttttactttatctgaagagtctactagaatgcagtgttgctgcctgagcagcagggcattagctttgtaaaagctctgttccttggcaaccccaccactaatatgaagtgcagaacatttgaattgtctttgaccagcttcagcatcagcactattttttttttttgctagacccctagtaggtatttaaaagtacagaaatagaatttaatcatgctttttaccaaatgtgctatgctcttagagattctttcaacgtgcataaaaattctgcagtttcaccacataccagtaaaagaaactcagtcactcatttagccatttagtaaaaagaacaaattaactgatgagcatagtggagacctcaaaggtaaagaagacaatgtccctgaaataaagacaatcataaattttcaatcaaaataatgaaatttaggctgggcatggtggctcatgcctatgatcctagcactttggaaggctaaggtgggaggattgtttgaggccaggagttcaagaccagcctcagcaaaaaagtgagaccctgtctccacaaaaaaattttaaaaattatctgggtgtggtggtatgcaccggtggtctcagctactcaagaggctgaggtggaggatcaccagagctcaggggttggagactacagtgagctatgattgtaccactgcactcaaacttgcatgacagaatgagtccttgtctctaataataacaaaatttaatttttatagactgtgaaaaaccattatgtagatacagttcaagtacagtatgattttataggatagataacttttgcttgaaaatgtattcccaatttataggatagataacttttgcttgaaaatgtattcacaatagagttagtatttggggcacacctttatccatttaacaaacatgttttgagcactgccaggtagcaacacgttactaggcactagagtgagaaaagattacagttcctgctctcatggatctcatggtctagtcaactggaatgaaaggattacataagtagaggtaaagacacacatgatggaggatggagaatagtcaaaggtctggagaatgaccaggacgtcactgtgagttgtctaattgcactgaagcatggatgaagaattggaaagtcattgtaagaagcctaaaaaggtatctctcagggatgctatgaggttctgaatgttatgtacgctatttgggcttcaacaggcaggcactgagtattcagtataaatttttgagcagggaatccaccagaagaactatgcatctggaggattaatctggaaagattgtgtagaatgttatgcagtgaaagagtctgagatgaaacagttaggagggtgtattaataacataggtgaagtgtaatgaataaccaggctggaggaaaagcaataacgatggaatcaaccgggcaagaagtataacaattaggatcagtaaaatagaatttggattggaggaatgaaaaaaaaagggacaaaacaaagttgaactgctggtatccatactggaaaatacagatgtcattcaaataaataatgtaatgaatataagaaaccagttttaggagtgaagtggatgttggcttgaaaatatttcctttgaggtttcagtcaaatgaaaaggtcctgaaatgctacgtggtagcctaagaaggaagcgttcctagagagaaaaaaattagaaaagatttacatttgataatttaatcttttccttcatacaagctaaattgataagaaagtaaaacctatagttttcaccactcttttacaaatatccctaaccttttagatattcacatgaataattgagaaaaatctaacagatgacttgcttatgtcatttgtctgctttatccttaggttcctctggcttatatattgttcaataaaatacagatcattgatattgtacaatgtactgataatggggagtgaatccatgcttgtgcattcttttttttttttttttttgatttgcagagggcgtgcccagtcaacaagagaggcacaattgtttttatcatcacctcttctcatctaattccatgaaggagagtagtattaccatacaacagataatgagttggaaaacaagaaacctaacctcagaacttaaggcttggggaaaaataaaagagtaatttgtgtttaatgcctgtataacttggcaagagggacatataaggcttagtgatgcccaacatgtgcttagatgtggattgttagttgatgtcttgggggttctgtaatctaagctaaatgctcaaaatcaattaattgatgttagacacagagatctgctttgatccctctttatcgtatttctaggccttcccattctcaagagcctgagaaacgacagctttccttaataacttgttatttgtggtaggagatgaaactttgataaaaacacaattatttttaaatgtctctttttcactctaggctgttgtatgtatttcaaaaagttacttttgaccctttccagaatgagaaagcaatcaagaagattataatatcttgcttagttttctgctcaatttatcaacaaatatttcttaagcaattattaagctgagcagtgctcagcgctgtacttggtgatataggaaatggggaaaagactgtctttaaggcctttataatagtaattacctcaacttgtctgtttcttttccttaccatttcgccaaattcattgatctatcttgttctcaaagcaatcgccatagttatattgtaacacagcattttctagggtgtccccattaagttgagagtgttgacaagaaaatacaagcttatttatcattgtaaaacttgagacacctagtagttaccctaaattaaatatttgttggagtcagtcacactaaagagaacacttactgcattgaacaatttacctacattagacagcatttaaagactatgccacagcaaaggcccatggaattcttgtgaacacagaatagaagtgtattaaggaacaagcttaattctgttctcttaaagcacaacactttctcaaaacatattttgaaatcacctttgaccattttttttaactaataggtgggtgggagttagggtaggaaaacacaagcagcttcatcaaaacgatattctattttcttcaaatttgtggggaatcatacggcctctcaattttctacattatgctaattatgatattaatctctctgccagcaaatgaaaataatacatattagatgtagcaaatgtcaataatgacaaaattagtcatcatgcagatactcagggattcccaaaatatgtttggattatgattgctagctttgagtttgcccagaatcgtttcaataaaaataagggactcaaacacatttggagcaaaactcacatcataaattttagacatagctctgccaataatgctctcagttatattttcagtcctaatatttcctctgagttccagaccagtatcttcaactgtctgattgatactctctccttcatttctgtctccaatgcattaagtcctgtgtatttactttccaaatgccacttggttccatgcacttctctccatttctgccactgactcctcctcaatccaagcgaccatctttcctcactttaactaccatgatatctcctgcttggtctccttacttctattcccgggctcctccaatccattcatcctccagcagagaatgatgactagcaccttccacagtgtctggctaataggaggtatccaatcaataattgacttacagagtgaaaatataggcatggcaaataccagtagagaactacagggttttagaaccaatgacattagatacttccatcaaatatttacagtgtataatcaagttgacttgcacattgtcttatttttgaaaaacaattttgttggctttttctatatgcacacatacatattgtatcaccctctacccgccaaatggcttttgaagaagtatttatgtggctccaaattgataatacctctagagagaagagaaattagaaattttaaaatgacctatgcttcctttcgaatatcacgtcctgagacagtgttttttgagttacgtgcaatatgttccacgatgaaacatttaatgtgttcagaggcatgctagtaatcatgtagaaagaattttatgcctgaagtcacatgttctataaccaggatcacttaataagaaaacaagtacagctgtggacaagatgcctttttatcagggaaaggccaatttgttttctttgcaaatctaagtaaatggagagaaaaacacagcccttaaatgttttctatttgtcctgaagttctcatgaatgagttagaaggcgagaaggattaaataaatccttgaacgtagagagagctaacatttattttagcaaactaaaacctattcgctttgcaaagttctgttctgtactttgtaacaacagttttctttaaaacaagagccaccaattcaaatgcctttacagaatgattgaatgctttcatgccccacctaaaggcattcaaatcattaatcaaacaaagttctaacgccaaaacatgtctgggaccagatttaaaatgtagccctcagtttcagagggcaaaaacttaacatatttatattttcctcactttaggtaacactgtattgaatctctgcttgaaattgaggagcacgtgattttttctttttggcccagggcagcatttcttggaagagaaagaaaaacaacccaagatacccttacaaaacatgtagtacttaaagctctttatgatgaattaattttggtatacacattaatagcagtgataataacaaatctatatatatatatataattgatatgaataagataaatacatcaaaaggaaatttcattacaatttgatattaggtaaatgtcccattaaaataaattgctactgtacataattttccttcagttcattggcaggatgtttgctttggaaaataaacagtctatttctagttttagaaggaattctcattattcttttatagcaaccattatcaggagcagatgggaaattgtaccaagagcatatctactattatacctcacaggaaaaagagagtattaaatgaaatctaacaaggcctgctcctgactctagttcctgtaacaaatgaacacacacatttgtatggtttcagcatttgtattagtaaggtacaataaatgtttactgaaattgaaaaaaaaaaagataacaggagaaagaagaggctaaaaaggtgcattttatttctgatcgttcattgtaaagactgctcctttttaaaataatcaaattttattttatatacagagggtacatgtacaggcttgtcacaggggaatagcgcatgatgctgaggtttggggtacagatctcatcacccaaacagtgagcatagtacctacctgatgagtagtttttcaaccaatgcgcaccctccctccttcccacatctactagtccgcggtatctgttgttcgcatatttacgtccatatatgctctatgtttagctcccacttataagtgagaacatatagtgtttgtttttcctgttcctgcgttaatttgcttatgattatggcctccaactgcatccgtgcttccgcaaaggacatgatttcattctttttatgactatgtagtatttcatggtgtatatgtaccacattttctttatccaatctaccattgtttcacaactagatggattccatgtctttgctattgtgaatagcacaagacaggacctttttatttgactgagttccttgcaaattactaataaaagatctggaggtccttagttaaaagttgaatctgtagtgccgttcaaatttagagatgtattttctgttcaagagaagaaagccctcattcggtcatgcttaatattcagctgtaaagtccaaaacatatgagaatgacacaaatggaaacattttataaatacctatacaaaggaggggcacttagttcccctaggcctcttaaaagtcctctagaaagagggtacttttatgctaactattaaagatgagtaacgaatttgtcctatacaacttaacagtatcgtcaaggaagtagaaagttactcagttttactgggcattggagctaagcttgaaagtgaggaggagaagcggcaggagacggagccgagaaggcagtggggagaagaggaggatggtcctttccatgctccctgttgtactaacatgtttggatattatcttatacttcatatatggactggattcttgtccttctcattctgagctctccttgaccttgattcttacctcctataactttcattctttctttactcaaaaaaaggccatttatttcagccatttttcactgttttcttatccttcctagttgcttttctatactatttttccactcttttttttttctatactattttgcccttctctccattttcctaactgctagatttccccaattttagccatctttcaattgttctgactatcctcaggtgctcccacaaggttatcagaccttccaccaagacggaatccctcagtctatggacaggctaagttgaatgggtcctggtgctgtgcttagcatatgccttgagtatttgtgcatttattttgcttctttacaaaaatccatcatccgatagaagttgaaagaaacttgctgaagcacattaaaatctctgaaaacagtattggctatattttctaataattagcatgactggttaacttgctttatttatcattgaaaaaagtatcagaaactgtatatcaaactcctgaattcttggcactgacgaagagacacaatgagaatgaccttaggataaaaaaacaagataaagcaccatatttgtaggaaattgcaccataaaagtctgtttcacaactctcccaaatttcattttattacatcttttctcttgaccaatcagtaaactcggttaatgatttacctgtctcaaaataattcatgaacaaaattacaagtaaatctcagtattggattcttgaaacatctccttgttcaatgaagtttcctttttcttccctctatttccctgtatttatcttttcttccagttgcattttatctcttctgtttttttatcttgctccctagtttgtgattttttgccaattttttatttcctacataattcatccaatctgtcattgtacaatttcttataactgcttcttagcttattccttttcttcatttgtcacattctatttttcatctattgtgttttcatgcagttttggaaagttttacaaatagacttttaaaaaaatgtacgtaatgttttcatagaaaaggtagtggtttctttttcttatatccttccctgtataaaaataaaaatgtagcagttctttctttgcctatgtttcctctttccttcccccaatttgaccagacttgaaggacttagatatgtaacagtgttattttctataatttaggaacagcttttgacttaaaaagcagaagagaagttgaaaataatatagtaattctacatgtccttcctgcttcccaactctctgcacatgtttgtaacctcccctttcttttttagtgtatctctttcatatacctttgtccccagaaattctgattcagtagacttagaatggaattctgggcttttatattttgaaaagctccccacgggagttagatatgcacttcttattaagaatgaatgcttaatattggaatcaaaacacaataagctttctaactatgatgaataatccaacagatttaattatgattttctttttgtccagaaccaagactagatgttaattgccagagaaatagataagaatgcctatgacagcagtacattaatatgatatcaaagcttggaaattttattggtaatgaataattcagtacttaaaatatttagaagctatagaattaaaattaattaatgttgttcactgtgtgaataaagttgattgagattttacatttaattttgtaaacccagtgttatcttttccagctcagaaaacaccacatacaagctactactttctgttttgatcccttatttttctttcttatgctttatcactgaaaactctccttgagcaggccatgcactgtaaatatttctcctggttgcaaaaccttctcatacaaatgcagtagactgtgtaatgagctcttctttcacaaaattaaaaaaacctgaaagccctgatttgcgattctatacaaatgagatttagatctaacaattttaaattattgcttcactcttagctgttcaattctatctcttatttgggaaaccgaaataataaaaccattgctgattccacaattaggttgtaaaagtcaccgtagccatcagccatgaagcaaaagtgccaagatcaaaactacaaagcaaagaggctgagataaaaatgctgcagcattagtttatagcattataagcagcaataagaattccttgattgcttaacaaagactcaaaaggcatttactccattaccttacaactcaaagaggtattcctggaccagcagtattggcatttttttgaagtttgtaggaaatgcagaattttggtgcctccacggacctaatgcagcagaacttgcagtttagtaagatctccaggagatttgtatgcgcattaaagtctaggaagcaccgctatggtatacatctgatgtgtgcccatgcattttttaaaagtatgaagtaatagttgtaagtattggacactcttgaaggaacaaataagagccatggtctttactctctaaatacctccctgacatctatgttttaggcaaaatttttttcccatttcagtagtcactgatgcttgcacgatgcagtttattccaaaacaatggtgattctcatgtaatagttcatgttgccttaataatttacgttgcctcaagttctctgcccaggccccaatatacaccgagggctgtactcctcccctaacgcctgctctcatacagtggcatagagcccagttttatgctcttggtcacatcatggagattgcacaccacaggctttaacttctgccgtactctcactgcctctaaccctccatatgcctaagttctacgattctttaaattccaaattgacccagaagtctcctccgctcatccttttcactgagatcatccctcttctggcctaccatttgttgatcaccttgctttttttttatcctactgtatgtagtataacaaattatcacttgcaactgtgtcttattttttcaactagattatgtactgcctaagacctagaaaattgtgcttatttatttgaatctctaggaggatcagtaatgggtattaatactaatgactccatggtgatgatgagcctgaacttcctcccttcctttctttctacctctctcctttcctcccttcttttcttcctccattccttcctctcttcctccctccgcttcttccccacttcccttattcatagattcatgcgttcactcagcaaatgcttactgaaaccttccatgcatcagacattgtactaaacaataggaaactatcatgaataagacacaatatctgacctcaaagaatttatgatataaaagtaatggcataaaccgtgattacttttgcaccaacctaatatatagacacagtttgttatgactggtgtctctattactaagcaatgactgtcacatgcaacgctgatctgaacaggtggtaaagagtgagatgtaagcaatggagcaaagccaactagttacaaggaaatatcacatgtttactagagcacatctcatgggcattcaagagagtatggccaggacagcttgtgaatagttcagtaactgtgcatagttttatattcattgtgaggcaccgtgtcaccggtttgctgatttacagagtattttaattgctaactgtatgctaccaaaatttccagtattcgaaaataattttgcttgaatgtagaaaaagaaaaaagccaagaaatgtatgtgaaacgagagtctaagggagctttacctcagtctcagaaaacatgcattccttccttcatttaggaagcatgtactggggtctactgtcagcttgctattgtgtcaaggagtaggagaatacaaaaatattagagaatatgaatcacatctattaggagagttttctacatacgcacattattctgtcagtgacataaggatttgagtcattcagatttaaatacggtaggtacctcaagttctcagatattatttcattttctaaggttcgtatttagttaatatgttattttaatggccttacaaattctagattatcttttttaaaaagttaaatagaacgtaattgccatttttatttaatggtaaaaagcatttttgtttttgtgtgtacttggttgtaatattctccttttcaattgagctatttttctgatactttactcttaaaatttcattcaggaaaaaagtaaacaatatttaagcttgacaatcataaaaatgctctggtgactatagattattttaaaatttattactgtagcttagggatatcttgatgggatgctcctgaaagcaattaattctcagttttttgtggcttctaatgcaaaatacattgacgcagacagaatttgaaatgaattttcttctaatatagcaattaattttatttaaatatctctagagtttttttttaatactgtgactaacctatgtttgttctttttcacctctcgtatccacgatcactaagaaacccaaatactttgttcatgtttaaattttacaacatttcatagactattaaacatggaacatccttgtggggacaagaaatcgaatttgctcttgaaaaggtttccaactaattgatttgtaggacattataacatcctctagctgacaagcttacaaaaataaaaactggagctaaccgagagggtgcttttttccctgacacataaaaggtgtctttctgtcttgtatcctttggatatgggcatgtcagtttcatagggaaattttcacatggagcttttgtatttctttctttgccagtacaactgcatgtggtagcacactgtttaatcttttctcaaataaaaagacatggggcttcatttttgttttgcctttttggtatcttacaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggtagggcgacagatctaataggaatgaaaacattttagcagactttttaagctttctttagaagaatatttcatgagagattataagcagggtgaaaggcactaacattaaagaacctatcaaccattaatcaacagcagtaaagaaattttttatttctttttttcatatactaaaatatatacttgtggctagttagtggttttctgctattttaaacttgaagtttgctttaaaaatcacccatgattgcttaaaggtgaatatcttcaatatattttaacttcaacaagctgaatctcagttgtttttcaagaagattttagaaagcaattataaatgattgttttgtaggaaagacagatctttgcttagttttaaaaatagctatgaatatgactatgaagctaaaaaaagtgatagtgtcacttacctctagtttcaccacatttgtgaatacattcttgaaggggaacttgagccaaagaggtacaagtttaatggggaaaacaaaacctcaaaaaggttactgtcaaattcaatcatcatttaaatttcccttggaatgtattgaaggcacagaaagccaaatgcgtgctgctgcagttggaaagcctagagagtttataaatgggattttgtattatgcttccagttgttgatgttaatgtgtcttgtttcgtaaaggaagacttggcctttatttaccaaatgagactattgttatgaacaatgaaaacttcgttcttttgccaagctcttgcatcccacccatcatccacataataggtggattttaatattcaggaagctagaacaactcattgatgaatatctttcgttaagatgtattaaaaagaagattttggaattatgtcagttgtctttgcccacctcctctttccctctttattcatgttacattattcagaaagtagatacaattcatattttgtacaaaataaacacattagttgacctaaacacacacacacacacacacacacacacacacacacacacacacacacacacacacaccccttgccaaagttaaagaattatagcctcatcaaaagatattttgaataattaagtcttggttttgaaaatcttcttgattatagatagataaaataaagaactaaactttgtagttaaactacttccttaggtaagtcatatacttttttcccagattgaaattcttctcttaatcatacaagtattttattatttagataactgatgtgcttatactatgaacaggtataaacctgtataatgtcatttctgaactaggctcaatctaatccaaattaagatggtaagaaatgagaaaattaaaaaaattgaataccatactataaatatatatatacggagagaattcataaagtggattaaatcgactggaagattatttttctataatatataaagtattgtttcctattttaaatgtcttactcatatagtatttgaatagagtgtattaacattccctctgataactctaattcacctgaattttcaaaatcttgttatctgttattgggctctaaaggcacattataatttataaacaaagatgtagcaatatgcctgtttcaccaaataagctctaaaattttagatctttctaattttataagaaagtggtatatgctgactctgttgtgaaatagtatacaaattttaagttaattacagctagggatttggctgtaattaggaaaaaaattttcccatttaaacatgttgacctacattaaatattgcacttcagtgctttaaaaagtcaagttcagcttccttgagttttttttttaagctgagcttttaaagttgtctatttcacgctacattttaaaaataaatgttaacatatttaaatttccactgagaccacttttgtggcatacttcctcaggatttttatatcacttaaattttatgaaatgtaaaaatgtaataaaatataagtactggttctaccaatatactcatagctatttctaagcatccagtagcaaatcaagtaaaaattaataaaataatattttatgaataatatgttaacctaacaattaattatagaagggctgtaatcacgaacctattgctaatcaatagtgtactctcagtgcaacgcaagcagatgttagaagggaatagaagttatttattgcaccggtgaaaaatatataagatgcctattcaacttaacaacagtagtcttcgtttgtaatggactttaagtacagcggttagaaatatttaacattttttagtccagggacatcaatgaaagaaagtgtataaattcaagctagatgtctatatggagccctgtagttgcaaaactttaagtcttctgaaattttaagatattagaaataggaaaaaaaatctcaaaagttcaaataatagtggacatccaagaaggttagtctatgttggaagcaaatgaagtgtgaaatgtagtcagttagcgatgcagtttaagatagacaattcactacagcttcaattatgtaacagaagaactggatacatctataggcttaagcatgataataatgagtttaatgatggcgtagccaccaaaactgtctttgtacacgaaggaggtgcaaataaaaacctatcatcggctgtaaggggaagtcataggttgatacaaagcaagcctgtgtacaagtctttaagcaagcgtccatgaatagcaaggggcgccatgctcttcactggagaagaaaattacctatttgtctttactaacctctaactgaaattaagcattccttttcattttgaaagtaggcaaaaaaatcacagtagtacaatcagtacctatgaagtcacagatatgtacacatctcattacagttataataaatatatcaaaatatcatttatgcttatcactacttcaaaactgcagtacttattatatgtgctacagggtcttattgttgggctttaaaacattattctgaggaatgtcaggcttcaacagattgccaaagaagtccaaggcataaaaaaatgatcctagccagctgtctgtttatctgcccagaatctcatcctaatttactatggtttcagtcattttaatgtgcagtcactatcttcatacactccttttcttctggagtattctaggagaagacataccagtcgaggggttctggggagccaggccttcaagcaatggattgctgacaacataatgaagaggattttacttagaataatgtcagttgataaaagtttgaatgggagacggaagcaaggcagtgggaagtggaattcctaaattgaggaacctctgaatcataatccttagcaataataattaagatttcaaaacattataattctttcttcttttagacaagtctgatattgcttatcccatatcacagataaggcaattattctactaatatgcattaaggaatagtggttttaatttaagtgttaccttaatgaaaataattttgaattttttccttccccaagtctttttgtgaaaaatttcaaacatatagaaaaattgaaacaattgcaaaacatatgcccatttacactgttttcctccccctaaattcttagagtcaacaattgttaacattttgccatatatgctttttttctctcgctttctctaccctctttctgtatctctcatatatagggcatcacacacacacacacacacacacacacacactttttaacatttttgcaaataagttataaataccattatattttacccctaaataattcagcatgtgtcgctttgaaatacagacatgccatatataaccatgcctgtttattatgctctcctccaaattaaatataatactgcattattgttaatatccattccatattcatatttccttaatagttcaaaaatgtcttttatattttgcaggggagttagtaccaatatcttatcatggctcatgcattacatttggttattattatttttcatccttcttagtctaaaatagcccttccacatttttttcaccgatattgaaatttgaaaatgtccaggacgctagcctcaaaaaatgtctcatctttcaggatttgttttattttttttcccctgatgggatgatttaacttgttctgtagtctctgaatttctagtaaactggaagttaggtctaaataagacttcaagagatgcatgtcaaacatgtttggcgagaatacttcatatgagatgctgtgtattttgtattacgtcacatcaggaggtgcatcatatgaagtagtctcactaaatgctgcaaagttttattacttgcttcaggtggtgactgacagatcttgcattataatgtcacattttttcttcgcaattaataaatcatctaatggctttagtatccattgatgatccttccctaactcagttattacactggggcttgcaaaatggaggttttcctaatctgacatgatcttaacatttaccagctggctttcttctgtttgaaaaaaaaaaaaaaaaaaggtttttcctctatatttatgtcaaaatggactcataaatttttatttattcaatatattattatgaattacagttattattcttgcccagagcttcctgctcaattgtcccaggctcaccttggactttgcctatcccagatttagaattacccatttttttcaaggaactctggttacttttagaggtgaatagtacgtagaaacgtacatctgggtagtagccccttctcaatggaatgtgtgcacctttctggcaagcagtcccaaaggagataatattttcagattaccttggaaatgattcttgacaaatctctttcagaatacatggaagttaaaagtaagtctagacatgttaaaaagcccttcttgtgtgagacttcatgtacggtcattaagttactactcctttaaacctctctacttctgaattcttaaaccaaaatgtactagtatataatctatgctggtttgccatgcaaattaatggtgtaaataagataatgggaggcattcgtaaatgtacttaaaggaagaaattattgtttaaagaccttagctcattgtttgcatgcaaatacacgctgttgattagaaatgagccttatctaattcattaaagtaggcctggttggtcctcttcttgaaagtctccattagcaattcatattgctctatgcgcttccttgtaagacaactgttgtctcttaagttttctttaactttggcttcttacaaattcagaccccacccccaaccaaatagctttcaaccaaatagcttttcagcatcttatttcctacaaattaaaagcgaatattttaatgactcaaatggctctttacagtgtgtgcaatatgttaaatgtacccagtatatccgtgtgaaccagtgctacaagcctgctcacacattcacattttgcccccaggatctgtcccgtccgcttgctctgtactcaaacttcctttttttctcattgccagtttagaccttgactctccatccagcccagagtttggaaactgagtacccacaggctgaatcctgaatgcatgcagtatttttgcatagccactgtttttaaataattgacaacttttaaaaattgagagacctcattttttaaaaaaatatggatttctgtcttcttttgaaaatttagatctggctactaggcactcattactatattttctcttggcaccatcacctacaactgagtaacagatgtttcattttcttgctactcaaagtgtggtctctggtccagagcacagacatcacctgggagttgctaagaaatgcagaatctaataaataacagtcagcatttttaataagatttccaagtttccaagtgattcatgggcacattaaagtttgagaagcattgcctggggtaagcaagctttgtcctcagtttgcagcacctgtcccactttgctcatttatattaattgcttttccatagatatttgattttatagtacctcatgcagacctttgtatgatgatgacggttagggtggtgatggaagtgatggtgataacacttaatattgccatgcactgttccaagtgttttacgtagctcaatacttataacaactctatgaaatagttgctattctccttttaattttacaggagggcaacgaaggcacagactgataaaactctttgcccaagattgcacagccagcaagtatttgaaccaggatgcagtcccgcagtctgcctccggagtccttactctagatcagattttgcattatttatcccagttttgtccatcaggattctctggtatacacttgcaatttcttcctaccaaccttctccttacctttgatggccacacgtagtagcaaaagaattgaacatagaatctgttctgacctatctttccaaccctgtttttcataatttccactatttctgtttatgtctgaagctttgaatgacctgaagttttctgttcttcagcttttgcaaaaaaaaaaaaacaaagaacaaaaaacaagacaaaaaaaaaaaaaaaccgcttcctttggttgaattctctttccccttattttttttcccaaaatcttacacatcccttaagactcatcttaactgctattacctcaatgaattgtgacctgctcttctcaaacataagcagtttattctcttaaggttttcttgcccctttttataacactcatgtaatattgtatgtatatatcatgtatcatacctatttacatatgcttttcccccagcaagattaaaagcttcatgagggcagaggactctcttattgttatctctataacccacagtacttaccagaaagcctgatatattgtagatggccagtaagtactttcttaatttaaatcgtaagaattttattcacattcagattaaactgaagatttaaatctttacacttgacattattatatagattaaaaatagatctaaagagccagaccaatttttctgtttttatcatgttatcacatttccatggatacgtttgcaattctagaaattgaccttgatcccttctagtcttaaaaaaatggaaggagtttggttaataatattttaggtattcttcagaatttagtacatttaagagacaagtaacttcaatttatttagctagttatggcaaaaagcagctctttgattcaaacattttgtacatttgtttatcctactctcactgtatctcaactaataccttttaagtgaattaagcaggaattagccctgaaactgaatgttttagcctcatcctacatatagccacaagatgttttagatgcaatccatatcaccaaagagctatttttagattgatcagagagaatcatacagatattattattcacaggtgtcaatggaaaagctggtctcttcccatctgttctctgatgactcttgaaaagctttcaagggcattcataattcttcatcaaaagactatgaaaaatcagcttcatagttaattgttttatgtcatattttattttttcaacttggctagttctagtgaaacagactagctggcaccaaatatgttgttgcattggctggtaatgatgataccactgtgtggagatatacaagtgaatgtactttatttgtggccttccatgaactttatgtgcctgggaaagtaggagttagggagagtttgttagggaacgtgatctctgggatgggtcttaaaggatgagaagaggcaaatgaagagtaaatggacatgccagagagaaaaagtgacaggagcaaaatcactgaagcaagaaaaaatggcctacattgaaggactatacacagttcagtataaaaaggctctgttaagcaagcaccattgacttaccctaaactcttcattttctacatataaactgcccaattcccactccaaacctattgatggatattagtaacctattgatgtttttgaaaggtgttcaagtatcctttctggtaccatgtaccttggctcccaccatttgagagtatgttctccaagaggcaacagtctgtggttcctgacctggctatgcaagttattcttattattaaaattgtcctatttaattaaatatcatgaaaactaatgaaatagaaatgaaaagataagagaattgtggtttctatgaatactaaattgaatgctttggaagacttgataaaggtgattagaaaaaaaaaaaaggccagatgcggtggctcacacctataatcccagcactttgggaggccgagatgggtggatcacctgaggtcaggatttcgagaccagcctggccaacatggcgaaaccacatcgctactaagaaaatacaaaacttagccagacgtgggcctgtagtcccagctacatgggagtctgaggtgggagagttgctcgaacccgggaggcggaggttgcagtgagacaagatcatgccattgcactccagcctgggtgacagagtgaggaaaaaaaaaaaaaaaaaaaaaaccacggtgctgttgaattagatgtaggtaagacaactgtttaagattgggtatgagggatagaatccccaaaaaatggaggtattttgcattgagattattttcagcatctccaaatctgactgtaattcaaagaaaccaaactaaaagtcacagattatgaaatgtagaagtgttttatgcaaaaagtaatatgcttaacttcaacctgtgggcttttactccaggaaaagtctcggaccccataccaaatgagaagtaaatgagtgaccacttgtatattctaagaaaaataaaatgtttgaagatgtgtaaacacatttatataatccctccaattttacaatatttttccaaaaaccgcctatccacttaccctaatcaagtttgataaggggacttccttttatatgtaggaaggctgaaaaatgacgccatgacaaatgaaattgtcaagatggaccaggtcatggaagatttgaaatctcaaagaattttttccagggtagaatataaggatgttgggacgtttttatatgctttagatttgcatcctcatatgtccctttgacagttgagctcagagtgaaaaaaagagagtgaaactagtggcagggtgactcaagttagagacaatgagtaagcagaatagaactttaaaaacctgacagattcaagaaatacttgatgaaagtggaacaatttagtcgttaagtagatgggatgatgaggggaatgaagggacaattctaggatgatcccttttccaggttttttgcttgggggaactggctgcatggaaggctgttagtcaggataggaaatacaaaggagagtaactgaatggaaagaggaaagcaaatcagacatacagagctcaacttgggatataatagtcttaaggagctcttggaacattgaaaataaggtgatcagaaaacacgcatttgaataggtaagtctgaacatcaggaggaagacaagggctgaagacactgagccattttgctgtcaatgtagagatggtggcaatctccattgaactaactgcttctcaataaggtacctttctcaagtcattaatttgctaaccagtaaacaaaccagaattcccagagtacacattaaccattaagcactgctgtggaaaaggagttcaggtgtcaggaagccaacgtggcagatgagcactagtggtgacaaatgaaccaaagtgatatgggtgatctttatggggccacagagtaccactgtaaactatcacaaatcagaagggttgacaaacaaaatattggggataaatcagggaaaacctaccacaacatacaggaaaataagttcaaagatttcatcctacagattgcagataagaaatgagccctttttatttggggcaccctagggaaagagtagatgcccatatgtatatttaaagtatgaatacagcatttatttgaatatactgcaaatggtcaatacaagggtagctacagagcccataacatgaaaaggaaacacaaagaaatacatgccccagtcagactccttacttgggttgctgtaaattctctctccctttaaggttattgcatttaaagtctatctgttgattggacccaacagcagctgcaccaagactgtaccatttttaaaaaaaaaaaaaaaaaaaaaaaacaggccaaatggcattctgcatttattttccttgttgctgaagaaacttgaattgtctaccctcaaagcctgtcctttgagacacattttataattagaaacacttatttacaaagttctttttatgttagaatcacaaatcataacactccaaaaaaggaatacactatcctcaggtgagtgtcctacctttgtttacaaaagaaaacccaaagtcctaagagaaaaatgtgttgatcattttattgattccttaccttggtttaatatagttaatggatgtcttagatatgtataataagtctattatcatgttccctttaaaattctcttttgttttactaattatatgttgtcatagtttgaccattaatataagtctaaatttattataatgtgattttttctacaaaggttaatttgaattaaaatattttattttatctctctctactatgataaatgtttttaaaaatcgtttgtaaaatgaaagtactatatttgtgtaagctgccaatctaacaatttatcatttaccattatgatggtgaatgtataacaatccttatattcagcagaaagccttatctctcatttcagaggaatcttgccccggttaattattctgtctcttgaatgcacacaaacacaagcatatctttaccctttttctgctgcctcactatccctgatcaggtgaatgtttttagctcctagattacaatataaatatattcagacattcctttccaaatgcattcattccactgtacttgtcagagttcatagctgtgaataacagaacccagtttttgttgatagaagcggaaacggactttaggagaaagatacagacctgttcccattcctaaacaaagggatagaaaaccagctcaaaatgggcagaactcaaaaaagaggctcagctccaagaactatagtccaaatcataccctagattggatctcgaactcttggactcaagcgatccactcatcttagcctcccacagtgctgggattacaggcatgtgccacgacgtctggcccccatacactagatgtaaacgttgccatgcaccactctaccactgcagacactgggtgaagaatgtcattgctactggaaagaattctagatagtgccttataattctgtcactcattccagattcaaaaactgaacttcccccatcagattccatttgtatttggggattttgttcgacataatcagggcattcagattctgggcaaccaaagttaacaaatgtctcttacttcccctttcttgttattattcccatttgaatcttcttcatagttagtcactgttacttaaacacacattctctattatcacatttccctctcctctcttttgctgtttgcttttgatccaaaccactgctcagaaaccattattgccaataacaacaatgatttcttgtagttaaatccactggacatatcttagtcctattatccgtaggccatgtgccattaactgaacactttccgtattagcacttggtcctatcttatcttccaagtcactaatcttatctgaatttattcttacctctctatgtaattccttactatattgatgacactccttgctttacctgccccttacatcctgatgtttctctaggacatgttctgaaccctcccttcttctcattctatacggtttccctgattgttatccatagcaacaaatgtagctttcactgtatcaattagaataatatctagggagattaaaaaagaattatagtaactgaaacaaagtagaaatatattcatcttcttgtagaaggaatctgccagtaggtagtccgaggttggtatcattgctctatgatgttgaagatccagatcccttctgtctcacagatctgccatcctttggtgaggtccttacactcatggatcaagatgactatcagctctctatctatcacaactgcttttcaaaggctgcaaggtgtaggaagtggacaaaaaagggatacctctacccttttaaagggacttcatggaagatctacacaacactttagcttgtatgtcattggccagaatttattctcatgacaatgccaaactgcaatgggcattcaaaatgtagtggaatggatcatgggctaagcagctaagcagtctctaccaaagtcaccgatttcattttatggcctaagtctaatatttggcccaatatatagtttcagattagacctacatatgtagcttcaaatggaccatttcctcttctatgtctcaaagccatctcaaagtcagtatatccaaaactcaacatgttatattcctctcccaaaatctactgtgggtgatatcactatctattcatgtacccaaactataaatttggaagttacaagagctagtattaatgacactaagttttgtgcatttactctatgaacaggactttgataagagttttacaaatgtttcccacttaattgtcgcaatatctcagttatagagattttatacgtccatcatctcacctgactcttcgagatcataagcaaagcatggcagcattcttatgtccattttacaaattaccacattaagcacaagaaaaaacaagatatatgtccaaggctaaccaaagttatagaaggatcgagaactaaaagtcagtgatttagacccagatctgtgccttttcccttattgttacatatgaccatatctagctatgtgaacaaagcagctaatagtgacgacagggtagaacaaataagaaagtgaatattccccactacatttatgattatttgccagtttaacagcttcaagcctgtgtcttctcagatatgtgcttcctcttatgtctaaggaaaagtactatatttgatatgcttttatgaactttcttttttgagatggggttctggctctgtcactcaggctggaatgcagtggcatgatcacagttcactgcagccttgatctcccaggttcaagcgatcctccaacctcagcctcctgagtagctgggaccacagacacgggctactacacccagctatttcttttttttttttttttttttggtagaggcaggatttcactgtgttgcccacctggtctcaaactcctgaggtcaagtgatccacccacctcagcctcccaaagtgcggggattacaggcatgagccaatgtgattggcctgaattttttaaatttaattttattgaggtaaaatatacctctatataaataaaagtaaatatacctttaccatttttaagtatacagttcagtggtaataagtaaatttatgttatttttcccctttgtcccctctccctactcctatttctgatctctggtaaccaccaaggtagtgtctactttcatgagatccatgtttttagctcccacatgtgagtgacaacacataatatttgtctttctgtgcctggtttaccttacttaaaataattacctccagttctatccacgttgctgcaaatgacaggatttcaccctttgtatggctgaataatatcccatggtgcatatatatatatcacattttctttatccattcatcctataaattttaaatggtgtggaatttggagaatacttaaggaaaaatgacgattgtgtaaaaggaaagtatctacaaaagcaaggtttatctaccccataaagataacaagagaatctgtgaatgtggatacggtttctggagtgtttcagaggttgaaagattgtgaagaactggatgggtataaaaaaaagtgaggaggagaagaaatgaaagttctggaatgttctgtaaattgtagatgagttccctatattaattttaaaatgtaaattgagattataattattttttgatgatctatttttgctgggctgattctctgttggtgtaactctttaacgaatatgggtcacgtgggaccctggattttattagaattacatgtgcgaatcaaattctaactttatgagccaatataatgattgtttttttaatgattagagtctatccatgacaaaaacagcttgtttctcctactgacttatttggtgttttcttgctaattagcctttatactaggcagtagtaaatcagagtacttggacttcaggttggccattacataaacctggcaactaaatgctgggtaataatcacctatcttcccacctgtgtttattacctttggaagtatgtaacatggtatctttgcgtttatatttttaatttgttcttttttctcttgcaccagctacttaaattatctgagcttccttttactaatccaaaaataaagataatagtacatatttatagagatgttgtaagagtaagaggtaatgtaaataaattggctagctctatgcccagcacatgagtaggtgcttagaagttagtgtctgggtacatgacttctggggatgataaagtgagtagctcgataaatctccccaagaatcagtaaaatgggacacactggagaaaacatcttatgaccctggatatcaaccaacggcatatgctaaattaaaaagtgattatttataaaaagtactaaactttgtatatgaacaatatgaatttgtggtgtatttgcctgtattgcccccagtccccactcccagcttggtcaagcataatagttctatcaaggtagaacaagccatggaaataagcagcttcatcaccacagggactgattttatttgaagcagaagtttaaaactccatgtccagaagcattgtcagtaacggtggagacctaggcggcaaacaaaaaggcagaatagcaactcagctggcctaaagttgcagtcttgattggaacaagtaactgactggcagactggccagaaatttaatttaaccagcatatctgcaaaatgaggcagccgtaataggcctcagtaaggactccttgtgtctccttcatgaaaacttaaaatgtgcctgcatgttgaatataccctttaacacatataaagaacctttagcaaaacttggaagtcttactggcttgaggtatttaagatcaactgctggccaactattgactaatgcaaattaagctatgcttacctctaggaaactaggcatacagtttgtttctgttgtttgacagagaaagaatatcaacagccacacactgtggggaaacagattccacagatttcatctaggcaagttattaaaacttcaatttaaaaaacgctgggcataagaaggaacatcagaatttggggctcctttaatatgttatttaaaatgtcaaattttcaagaaaaatttacgatacgttcaactgtgacccattctcatggggaaaagcagtcaacaaaagttgtctctgaattggcccaggtattggcagatagagacttaaaggctcctactataaataccttcaaacaactgaagaaaagcatgtttaaataattaaatgaaagtatggtaacaataactacaaatagagaatctcaactaaaagatacacactatataaaagaaccaaatgaaaattctagaattggaaagtagaataaccaaaatttaaaaaaatcactaatggggctcaagagcagatagtaagacagaaaaaaaaaaaaatcagtaaatttgaaaatagataaataaaaattatccaatctgaatgtcagaggtaaaacagtataaaaaacgaacatgagtcatagctttgtgtcaaaacattgagcatatcaatgtagatgttacaagagttccagaaaaaaagagaatgttgttaaagaggcagaaaaattatttgaagaaataatggccaaacacttcacaaatacggttaagctcaacaaaccccaaatagaataaacacgaagagatcaataccctaaaacataagagtcaaactattgaaatagtttcatttgaaattattgaaagacaaatgggaaagtctttaaaacaaccagaaaaaaatgactcctcatgtacagggatcacatgattgatagttaatttctcatcataaacaatagaggccagaggtattgaaatgacatattcagagttctcagagaacacaaaattgccaaccaagaattccgcataaaacaaaactatccttcaaaaatataggtaaaataaatatattaccaagttgagaatgagaatatttcttgctagctgacctgacttacaagaaaaaactaaataaagtcattcaggctgaaaagaagtgatattcagtaactcgaacccaaatgaagagataaagaatcacagaactgataaatatgtagatacatataaaagactgtacaaatatagatatatgtttttcttcttttaacttctttaaaagacctaagattgcataaaaattataacattgtgttattgtgtttataagcaggaggagcaaaaatggagcttagcagagaaaaatatctaaattttactgtgttaaattagtttgaacttaagtaaattatgatcaattaagatgcatatgtaatctttagagcaagcactaagaaaataaatagttaaaaacaaaatttaaaattacacactaaaaataactaacaagacagtgcagtaaaggagaaacaggaacaaaaaagacatgaataagatgtgaaaaaatacaatatggcacatgtaattgcaactaaaagttgagaattcccattaaaaaaatctgaaatttgaaatgctctaaaatgtgaaactttctgaaggttgatataataccacaagtggaaaatttcacacctgacctgtaatgagtcacagtcaaaacacagccaaaactttgtttcatgcaaaaaattatttaagatactttataaaattacctccaggttatatgtataagatatctattaagatatatatatatacatatatatatatatacatatatatatatatacacatatatatatatatatatgtatatatatagtatgtgtgtttaaacttaggtcctatctccaagatattaggtatatgcaaatattacaaaatctaaagaaatccaaaatccaaaacacttccaatcccaagcattttggatatgggatactcaacctacatatcaatagttatagtaaatgggagtgaactaagcattccaattataggcagagatttcagacaggattatttaaaatatccaaccatagtttgtttaaaagagaaatgtattagagccaaaaccatataatttcaaagaaaaaagaggtactatgcaaattgtttacatataaaaaatgaagtgacaatactaatgtcagacaaaatagactttatgacaaaatatgtaacaagagaaaaagacatttttaattatataaggggtcaattaagcagaaaatataacaattataaacgtatataattaataggaaagtcccaaattctatgatgcagaaattgacagaattcaaaggagaactagacaattcaacaattattattggagacttcaaaccctactctcaatagctggcaggccaattagacagaaaaatagcaacaatatagaagaattcaccaacactatcaaccagcttgacctaactaacatttataggagacgccaccaaatgaaagcagaatacatattattttaaagtgcacatgaaattttctctgggatagattctatgctaggtcaaaaaacaaatctcaatacactcaacaggcttgaattcataaaaattatgttctcttaatatgtcagaattaaattggaattcaacagaaggaaatttggaagatatcaaaatattttgaaattcaacaacttctaaatccattggttaaaaactaaatcacataggaaattataaaatattttgaactgaataaaaataaaagcacaacatgtcaagatttataggatgtaactaaagcagtgcttacagggaaacttctagttttaaatacctattttagaaaagaataaaattcttaaatcattaactcaagctttcgccataagaaactagaaaaagaagaacacagtaagctcgaaggaagcataaggaaggaaataacgggggttagagcagaagtcaataaaatagaagaagaagaaagaaaaatcaatgaaaccatacattaatctttgaaaatattttttacatggagaagctttagctagactgaccaaaaaaaaaagaattaccaaaatcataaaggaaaaaggggtaattactaccaaccctacagaaattagaaagactagaatgtaataacatgaacaacattgtcaacaatttctgcaaaacatattaaatgaaaaaattcttagaaagacataaattaacaaaactgattcaagaaaaaaatagacatatgaatagacctaacacaaacacagaaactgaattagtaatttaaaattttccaacaaaaaaacccaggtccaggagaaagataggaatccgaggcatccacagtatagaagaagaaatgaaactctctttattcacagacaatacaatcctgtatgtagaaaaatctgatatccacaaaataactgctagatctgataagttcatgaagcttgcaagataatcaatatacaagaataaattacattcctgtgtactagcaataaaaaattgaaaatgatactaagaaaataatttcattctttgtagcataaaatagattaaatggtcataaatttgaaaatataagtactaaacctgtactctgaaaactgtaatacattgctgagagaaattaaaaatctaaataaatgggaccatattccatgttcatgaattggaagactcaatactgataaggtagtgattctccccaacttgttctatagatttaatgcaatctccatcgacatcttagcagatgttggcacaaattgaaaaattgcacaatcttggcacaaattgaaaaattgatcccacaatttatatatagcaattcaaatgtaccaaatagccaaaacaattgtgaaaaagaagaaaaaagttagaggactttgaaatcaggacattacctgatttcaaatcttgatgtaaatctgcaatgatgaagacagtgtggtactgtcataaggacaggcttatagatcacctgtaggtttaggaaacaaacctattcatatttttttcttaaatctactaactgcactcctaatgttgacaatggaagagactcgatagtccagcaataaactcttatatttatggtcaatcaatatatgacaaaggtgacaagataatccaatagaagaaaagcttattattgggtagcttattgttagtgtacagaaacagagctgattgttaatacaactcaacaggaaaaaggcaaataacttgatttttaaaatatttaaatatatatttctccaaagaagacatagaaatggccaacaggtatgtgaaaaggtgctcagcatcactagtcatcagggaaatgcaaatcaaaacctctgtgagatgaacactatcatctcacccctgttaggatggctactataaaaacaaaccaaaaacaagagataagaaatgttgttgaggatgtgaggaaatcggaacgctagtacaccataggtggtaatggaaaaatgatgcagctgctatagaacacagtagaaaggttcttgaaaaagttaaaaatagaactaccatatgatccagcaacctcactcctgggtatatatcccaaagaattaaaaccagaatctcaaaaagatatctgcactctcatcttctctgaagcattattcacagtagccaagatatcaatacagcatagctgtgcatggaagaatgcatggataaagaaaatgtggtgtattcatacagggaatattatttggccttaaaagggaaggacgtcctgccatatttgacaatatgtatgaacctggaaggcattatgctaagtgaaataagccagtcaccaaagggcaaatactgaatgattccatttatatgaggtgtctgagacagtcaaactcgtagaaccagagagtagaatgatagtaaccaggggctgggcgaagggggaactgggagttgctgttcaatgagtataaagtttcagttatataatgtaaataagttctaaagatctgctgtacaacatagtgcctgtactgtgcacttaaattattattaagaggatatgtcttaagtgttcctaccataagaagaagaagaagaaggagaaggagaaagtgaagaagaagaaagaaaaaatgaagggggcatgagcaaacttttggagttgatgcatatacttggttaccttgattatggggatggtttcatggttgtatgcttatatcccaattcatcacattgtatacagatgctcctcaccttaggatgggattgtgtcctgataaacccatcataaattgaaaatgttatgagtcaaaagtacattttcaattaatgatattttcaacttacagtgagtatatccagatataaccccatcctcagtccaggattatactaaatgtgtatcgcttttgcaccatggtgaacttcaaaattgtaagtcaaaccatcgtagtcagtcggggaagatctgtttgttaattatggacccatcgtgtacaccttaaatacttaataaagctgttaaatgaaaattaaaagttgactgggcacatggctcatgcctgtcatctcagtgctttgggaggccaaggcaagaggattgcttgaggccaggagttcaagaccagcttgggcacatagcaacattccatctctacataaaattaaaaatgtagccgactgtggtgatgcaagcctgtagtcctagatgctcgggaggctgagttgggagaatttcttgagcccaggagttggaggttacagtgagctataatcatgctaccacaccccaggagaccctgtctcaaaataaataaatagaagctttaaaaaatattggtatctcagtgttcctcattatccactgtatttaaggtttagctacttgtgcttgatgcttgacaaggtaatcttacttttctccctgatattggtatgatgcaaatttactatatatatgacacaaatttatatatgcaatattttctcgttaatggccttttattttactctcattttcattatgctttgccttttaagtcatatagcaaataaattatgtggcattttcttagcaactattaattcaggagaatgggaacagaattctctcatagattcagctggaaggtaatgatggtcagctcccagtggagaaaaaaaaaaaaactcccttcagttttcgtaaacatacagagaaattttctcctaagtgctatgtcagtctgctgtatgtcctattgatctgagaaccagaaaacacatattttagtttacactgccttgactctattgtacatggctaggtctgtttaaaaaagaaatccttgaagataccctttggattctagtattttaaaacggatgcttagctaagtgaagtggtctacttcaaggatcaaaaccaatcttgagtaatctgttaggtagactccctaagttcatctgtaccttgtaccaaatttttaatgaatttagtaattgacatggatgtaaaataaataatacactaataaagttcatgcagaatcaaattttaatgcccagaggtaatgtagaagatattacctgtccatttctctggacttagctcctgcaactctccatttttctctctaaactttagccacactgaattcctagtttcaattcctctgactcgctaagtatttcttctaccttgataaaagctaattcctttgtcttgtaccatctgtattccggctgatattgacatagttttcagggctcaatttcaatgttacttactcagagggactcactgttacaaccaccacagccttttcaatctaagtaagatccactgctcttcttagaaacaggttatattccaaatgactgtaagtgcttttgttcttagaacatatgtctccattcaaaagaccgatagatattcagttaagccctttgagaaaattataaatgttgaggaccttgattattattgttattattgcttcttttctatgttttcccaggactctcaacaaatttgctttgcttttgtactcatggcacataatgagattaataatgtttagaaaacatttcaaaaatacacacagaggagacacatcttagtctaaagttagacatgataccaaaaactataataactatagctgaccagtgaccccatttattcatggaaagtaaaatttgatgcatatttgcctttaggagcaacatacctatgaaagttctgaaagtgaaagtttgtaaaaaaggagtactctcctaacaatcttaatttttttctatatatatgtatggtttgcattaaactcttttgtatgattagtggtttaatgttgatgtcacccatgacaccataagctacgtgtatggactggctctgttttgttcactcctgaatatccagcaaaaatagtatagtgcctggcccttggtagatgtgtaataaatgtttggtgaatgcatagctacacttcaatgcttatcgcattttaatcccagctactcggaggctgaggcaggagaatcgtttgaacccaggaggtggaggttgctgtgagccaagatcgcgccactgcaccccagcctgggtgacagagcgagactccatctcaaaaaataaaaacaataaaaaaaaggagacccattcatgtatctgtatcactgactagcctgtcaacattttgttaactacctcatcaagtagcaaaatcagtacctggtatgtggtagatgctcaaatatttgttgataaaatacagtaagttaatgacaggcgagcttgcctcagtgaaatataatctgtaagtgagcagtgtgtatatcatttgaaggtgccctacttagcctagcatatcacagagattcccagtaaatatttaggcagttcattaactctaaaagttgaccctcatagtcattggcctacattattcacctccctctgtctctaataaattcattggcaaatttctgaactccaactggaatgtttgtggtggatttcttcatacctaatggattatttcaattttcattttacattgtattatttacttgtctgaggtctttataatgacaaactcggcatgcatgataagctgtcattacttatgccagttgacaaggacatattatttttctacaaaaaaaattatcttggccaggcgcggtgcctcacgcctgtaatcccagcactctgggaggccgaggcgggcggatcacgaggtcaagagatcgagaccatcctggtgaacatggtgaaaccctgtctctgttaaaaatacaaaaaaaaaaaaaaaaaagcagaacaaaacaaaacaaacaaacaggagtggtggcgggcgcctgtagtcccagctactcgggaggctgaagcagaagaattgctcgaacccgggaggcagaggttgcagtgagccgagatcgcaccactgcactccagccgggcgacagagtgagactccgtctcaaaaaaaaaaaaaaaagtggtaattgttcaaaatatttacttattaattcattttaaaattgcatgttgaaataaaaaataaatgtttagtttttaaactatctcttctacaacagaaacaatatagtgagaagagtgatcttgttttacatttttgcaaatctctttaaaagttagcttaagagaaggcagctggttcttatatctgtttctgcattgaatgtgctgtcatatctcgcatcatgtagcctctgaaaaactcataatagaatgagagaggaaaaagtcaaataacatcttagtattattacgaaaataatttggacctcacagaaccactgcatgggtctcagggactcccaggggtccccagaccacatttaaggaaatactgtttcagggaatataactatttttgtacctcctgtggctatattcttttaaagaatagtaacctctgtttctgaggaacttagctgcaattatgtgcagagtttaaataagtgaaacggaaataccctttgcctttctgctcgagtatgaaagtgatgatcaaaatgttcccttttctctctctctctctctctctctctctctctctctctctctctctctctcactctctggggaacttcgggtttccgtctctatataatgtattcatattccactggaaacatacatagtttgagaaaacagatgacattttttctgggggtggaaagaattactaccacgaggaattcaaaatacagacacagtaataaaaatcaccataaagcccagaggggaaaaaaattgagtaacaaaataggaggtgaaattataaaactgagtaacaaaaaagaggtgaaattataaaataaatgataaagttggttgtgggttaggaagaaagagaaatataaagaaactggcataatgtaaaagccaagacaagaaaagtgaggcagaggcataggtcttttgactattttccatgtttgattctaaggtaagtagatatagtttctcatagttggaaatgttcgtgaatttaaacagaattaatgtttataatcagatgcaatgtctagtttttctatttgtcctgtgaaataataattgtgtaaagtgctcatgattgtttcaaggggtgaggagtagttctaattatcatagatattttcatgacttcgcataccactggtttatagagattatacagattttcttatatcagaactctcgtatctttaattccctagtagatgtctaagaaggagatttatcacatagcagatggtggtaaacttgagtaaagtgccagatactaaatgcctttggctttgtgggccattcaatctttgctgcaactactcaactctgctattgtagcatgaaagtaaccatagacaatatgtaaatgaatgagtgtagctctgttccagtaaaactttatttacaaaaacaggtggtgagcacaacttggttcatgagccatagtttacaaacacttgctgtatagctttccctggttgaatttcgttaattttatacagaacctgcctcccatacacacacactttgttcttcatggaaaatctccccagactactatgaaataatgttattacttggagatatacaattaagatgatgtcattaggagattattaatataggaactaagcaaatactatatgctaagtactgaggatagggtgcgatcacaatagatagaaaatctgcaatagtttgatgaacatgggaaattacagtatttcctgtgatggaaacattatgaggggctgtgggactacataacaggacctgtgacctatacctgggttggggatgtctaattaatcaaggaaagctttgtagaggaagtgatgtctaacctgagattggaaaggtcaacctggagctacctagatgaagatgtatggaaggacatcccaggcagagggaacattgtatgatgaatcctgatatggatatagtgctggattttaaggaagagtaagttgttccatgaactatacagtgcaaagaaagatgaagaaatagaagtagagaccagatcacaaagggctttttgaccatgttagagaagttatattttatcccattggcactaggatgttgttgagtatatgaggacatgatcagcaacatattttagaaagatctcttattctgaagtgtaaagagtggataagaaggagacaaggtaggaggcacgagctaattagaaagcagtctcagagaggctgttagaaatcagaacagaatggctattattaaaaagtcaaaaaacaacagatgatggtgaggcttcagagaaaagggaatgcttatacactgtttatgggaatgtaaatgagtttaggcactgtggagagcagtttgaaaatttctcaaagaacttaaaagagagctgccattcaacccagcaatctcattacttggtatatatttaaaagaacacgaatctttctaccaaagagacacatgtactcacatgttcgtcgcagcactatacagtaacaaagacatggaatcaacctaggtgcccaccagtggtggattgaatgaaataaacgtggtatacatgcaccatggaatactacacagtcataaaaagcatacagtcacgccttttgtaggaacatggatgcagctggaggtcattatcctaagtgaattaatgcaggaacagaaaaccgaagatagttagaagctaaacattgggtactcattataaaggtgaaaacaatagacattggggactactagaagggggaggaaggagaggggcaagggttgaaaaactacctatcgggtactatgctcactacctgtgtgtggtgggatcatttttaccctaaaccttggcatcacacaacatactcaggtaacaaacctgtacgtatactacctggatcaaaaataaaagttgaaatcagaatgagaaggagcgaaggagacagcgacaggaggatggagagaagtgggcagattcaagagagatttctcaagtggacttatgaggacatgcttattgatacgctctgggagtgagggagagagaagaatcaaggatgacttctacactttcagcttaaaaaaccgggagctggtggagtcatccattgaacttgacagaggagcacgtttaggcaggaagatgatggtgtttgaatgtctgcgaagggaaaaactgaactgggattcaaatcagaaaaaacggtttgaagtcataccctcttaattgcattttctatcggatggtaatggctttgtgacaggctttactgataggtgatgtaactctgcctctgacagatgaagatccaaagcatcctcagattttcccgaagcctgtttcagcaactgtgtagacagcacacacaaaaatctggggggaagtcctagggctcagttagttgattggatctattaaagtagcattggagaacacagttcagtctgagatttcccaaacatattgctctataatttatttttacccagaaactgaattcgatgtgggatagggattataaaagccttcagattccagatagaatctctgaatagaaggcttttgggccacatctagtaatctcctttcctcactccatttctgaacttcttgttcacttcttcgctgtttttaggacgttcttactacactcctgcctcaaggcctttgtacttgttttctctgcttagggcgttctttcccgcaatatttgcatggcctcctccctcgcttctttatttctatattacctatctttattaaagctgctataaaaaaaaaaaagcccacacctcagtggcttaacataatagaaactttccgttcatgcaaactttacaaaaattttctggtcaacaagtagatttcctccaaatggtggatcaggggggcccagggcacttcgcttttgtggctctgatgtctttaacatacggatttcaaaatcactgtgctcttgtacataagaatgaaaaagaacaaggaatattacatatgtggtggtggttattggaggtggggttatgagccaggcttcatattcatgagcatcacttttgctcacactccattggctcgaactcagtcatgtagccaaactaatggcaagggagactgggaaatgacagctagctgcacaattaagagaaatgagtagacttgtctaatgagcagctagccagtccctaccacgaggactttgctcaaatgtctccttctccatggaaccttctatgatcaccctttataaaatcacaactgctccccatcttcccctcaatatttccatcccttttccatgcttcatttttttcctctgtaacacttactgtatcacaatctatagattttatttctttatcttgtttactgtctgcctccccttcctcccaatcggatgtaaggtccatgaggcagggattgctgccgatattcacggccatatcaatggacactagtagaccctcaataaatggctgttgcattgtgattacatatatgcttcacctagaagtagtctcatctggtggcacatttactcatagattgacattaattctctattgttttttccccagcaaaatttgtcaaggtagtttgtcagtagggagaaataaagttgtcaggtggctcatcaaaagttcaattttgagtactcctcctgtgtactcataatgttttataaatacttttatctatgtaagcacgtgggcttagacacaattctaggattaaaacagaaagctctgtatccatattttcccttttttgtacctccttttatgttctctaccattttttttgagtgctgttagtgaagcactaggctaaatcttgggtttctgcaaaaaaaactttaatcctcacaacactctaaaatgtttattgttctaattttaagacgaggaaactgagggctaaagagattaaggaactcgcccgtgttcacgtactcagctgataactggcagcatttagatttggacttactttccatacagatattcgcattgctaaccttcaggtttttccctcatcgttttccacatctactcaaaagttgctaatcatttccttaatagtgaggcataaatgactgagaaatcttgatatattatccccctcaggagcacttcattccgacaagacacaaactttagggaaaatgaacaaatgtctacttgtacaactcaagcaccaaccaggtatggtagacatgttggcttaaaaataaagttgatgcttgggttctgattctgataatgacctacggagggtatggcctgaggaggttactaggtgtgtgtagaaatcaatgttttgttttggttttccctcgggaagggtcaacttatacttgaatccttctgaagtttctcaaattacaagatggtcatttattttacttcaatcaaaacaacaaagtactgtccgggaaagatgtattgccttgacttattctcaatttatgcttattttggaggcttgtagaagtaaacctgatagaggagggcaaaaacacacacacacagacacacacacactgggagaaaataaatttaacacagtttagggattgactttggttgtatgacatcacaattgcaagagttggatgccattgtaaacaagctatggaaagaatactgttaaaagtaactcattaagtggttacatggtgtagctcatggacatatggcacagaaaaaagataaagctgtctttacataacataaaactgtattctgttatgtaaatgtgtgcttgtggcttgcagtaaaattcctagtgaaacattacctctagattcagcagtactatacctcaggccacatggatgtaagtaaagatgatgccctctggaaaactgagttaggcaacaacaagtgcatccatgaggatgcaaatttcaatgttgaaggtgcctgtgaagaatttgaacaaaattgttgcatgaaatatgaatgaagaagtgtgatctaatgacataatattttgtactatataattttaaagtagtacacacaatcaaattaatgaattaaacattatatgtaaacaggtgatcattgtatctccattttctaaagtttctatgttaaaggtgatcaaaaaacttggagagagggacttctcatttggaaaatgggatagtcacctttgggtatgtgatgtatcaatctctagaacttcagtttcttcattgaaagcatataaaaggcaatccaaaggatgtatggaatattaaaagattccactgtgaaactatctagcactttacctgaaacacttgttagatcccctcaccaaaatcatgccatgtgatttggcagtctattcctcttagcgtaagagtagcccgacagaaaatgttcattaagagttaatgttaaattcattgaatttagcaacacatgagtagcgcttcctttctgattatgcaaatctctcaccatcgtaatacgtgcttcctttaatttcattgggaacatttgtaatgtaaatggtaacagagccaatatttcaaacagaagccattctttctaaaaaaagctaaatgtctaaatgtattgaaatgcttctaaaagtaaaatatttagcacttatttgcagatgggtaatgttaaatatctcactcattattattactaccacttgtctgaataaatcctcccataagcattaagcaagtaggtaaacaaagaaataacacttcatgtgatgaatgccaatatgaagcacgtttaaactgttctgtcaagagacaagcctggaaatgctaactgtgtttctttgcttttctgcaatcatctgaatacataaattcaaattgcagcttttaaaacttcaaatcgaggcttttgaaatttcagaaaacacatgcgcttggaaaagcagattataacaaggtcccaacgggattttgtcaccatcttttttatatttcaaagtataaaaaaaatctagataagaaatgactaccaaatgttttcatatttaaaagatgctgtttttttaaaaaattaaatcactggaaaaaaagttttccacaaatatcgtgtaaaaagaaagacagcaaaaagcttagccaaagcttttactgtttaagtgatgatttattctgagagttcttaagagttttctaaattagtatatggttaatatccataaaatcatatgcaagatgctgtctttcaaattgatgctgaaggttaattataaaatgtacttaattatttatagtgtcccattgagtcccagatactctgtgtccaagaacactgtaaatacagaaagtttagcagaattatattggaaaggcagtaattcttcacaaattaacttattgatataatgcaatcccatttaaaaattttcagcgagaattgttttataatttgactgaatgatacattacataagttagaataactaaagtgggagagcgggttaacctaccagaaattaaacatattttaaagctgcaataattgacatagtgcattactgtcacaaaaatctacagtagatcaacaagcagaaacttaaaatatcatgaagaaagcaccataaatcaattcagaagagatggtgctgggggaaaaaatatcagtttctgaaaaactcttcaaggttagaaacaacactatataaatttaagatggattaaatatttggttgttcttttttaacaaatgaaagagtaaaggatcaagaataaatgagaatatctgaacaatggtaaaatggccacaattttaaggatactatcaatgaacataatatcaaagaaataaactgttaaattttatttagaaaaaactactaaaaggcaaaaaggaagctggaaacgtagtctcaattaatctatgtttcagataatgtgaaaagagctcttaaaaataggaaaacacaggaaaaatgggcaacagacattgccgataattgacagtggaaactaaataaatgacaaacatgtacacacatacaacattttcaactttcctattagtagaatacttaaaatatctatggcaagctttttatttgttttattggtatatcaattataatgctcaatagtggcaaaagtgtagtgagacaagtattttgtaactgttggtgggagtttacgagtgttctgagtaccaaccttgacagaaattcaacaatgtgtatctaaatccttaggattcccattgttaacttttcattctcattccagcagatacatgattcaaaatgtataaataaatgtgtttattgtagggttattcattataataaaaaatgaaagcaaacaaaattcctaataacacaataatggtgaaatatagggtacccctatatatcttattactaggatcttaaaaaatcaagtttttaaagcgtaattaatgacctacagagacacatagtagaataataaatgaagaaaataagcatacaatatagggtttgaacccagtaatacatataaatctcaactatgatgaataagcacaacatctctcctctgtactggatattcttgatagaaaaaaatatgctagtaaataatttgagacatatttgaaaagaggggagtgtttgatttagaattttctaaacttgagggttattattatttttttggtttgatattactttttcctgctccttaaatttttgtttgtttggggggtttggggttttcttttccttaaacgtgtctgcttctagatgaaagttgaaaatgtttaaaagccttgccaatgtgtctaggtttttcaaatgtaatcagattttagcaagattttacttaactaaaagtattcagaacactgtgcaaaatcatctggagtcaaatagtaatggaggcaatgatttgcagagtagaaacagagagagagaaaaagatgagatagaccctcaaaatctagacccaaggaattaaatctgcttggaacatttaaacaaataaaggatgcctgtactatactagacgttttcttcttccacaattgattctaaggtcagaatctgaggggaaatggtgctgttccacattctaaaacaaactgccagcaatcgagaccagccacttccccatagggtttactctaaagcaacagggattattatctctattccaagcaatttccaatctcctctgtactccgtgtcccaggcaagattaaaaagactcaggtaggaaggggtagtaagctttgtggggagtgcagtttgtggtaagggacagttccttctctttcatctctctgagtcagaagtagagacttcgagagaatcactgagagtaagtatgtagactccaagaaggaaaaagcatcctctcacttcaatgaatgtttggaatctgcagacctccttcccaggtctgtgtagcttttggagaggccagaagagcaccgtaggcattcctttggctttccatggccaagcacatagagtagaagaagaggaggaaccgtaaggttaaccatacataagaaatcaacaaaaggctttgaaattgacttttcctatttttcaatttaaataagagagaattgtcaatgattaaaattcataaaacgaagaaagaatggactcagaaaatagcaaacatgaaatgttaattattagttcaaaagttagtttaccgtgttttctctgccaactgattgctaatgactaaagtccttatttccagctttcctctctccccgagctccagatctcttgatttattaaactagtagtttccccaaaatatatgagacaacaaaatatactctcagctgaagtaaatagcattcatcttcccagtcagataaggcagaagtacttctagatcagatgttatattcgggataggttaaaaacagaccctgctcccagtgtcccaggaatgaacagtggatgtgcttatttctcattgcatgcgtgtatcaaaatatctcacgtaccctacaagtacatacacttactatgtccctacaaaaattaaaaacaataaatcataaacatttgtaaaaataagcgaataaatgtataaatgaatttaaaagagaatagacagaggggagaatgtaactttacgtgtcccagaacagactttgaacaggctcttatcatataggaaaactgaatgaatatatgcaagcataagtccaataaccagattctgatttacagaatgatcgcaactgtagttctctcaaggccctgtctttgaacaggctgtgtcttattcctgcaacatgctgatctatcttcatgcttcaagactcagatcattatcttctctgggatgtctcccaagcactgccccagaaataacttctcctcctataatacttaatcataatccttggcttacatgcttgtttcttctcattgactatgaaatcctcaagacaaggtatataacgtatatatctttaatcctaatgcccaattgagctcttagaaggtagtaagctcccaatacacatttgttaatttgaagcaaaaaaaaaaaaatagctaatcattcaaaaaactgaattatcacaaatgtccatctaaagtactatatttacacaattaaatgctatacagccaggttaatgaacagactaaaattatatgcaacatggattatcgtaaacataattttgaatgaaaaaggcgagacacaaaggagtataaagccatacaattccattttcataatattcagtaccggcaaaataatcaaagttgacagggtactggttatacttggaggcagtgactgcaaagggataagaggagatttctgagattctgataatattctatttccttctctggttgtacagtgtgttcaatttttaaaacactattgggctatacagttaaattgtgcagtgtcctgtacgtatattacacttcagttaaaagcttccatggaagctacacatagttcccaaaagacaacaaaacaaaaaattttcaattattttaagcacaaacaattttgttcagctgtcttacaatcgaatatgtaagaataaatttatggctaattagcatagagttatatgcattttcataattaaaacttccacgagtacaacatatgttaagtattttaaatcagtttttctctttcctcaaataaggttgtgagtcataattcggaaaacagtttagcatgtaataatttagtgttttattttaaaccaagctgaagccacataaagcagaactgctcaactgagccctatccaaatccttgacccacagaataagaagcagataaaatggctgctacttaaacaaaacaaaaaccttgtttatatttttgtcctctcattttccataagtatactttaattaaacattttaaaacttgtaactttaggttatatacttactttagttggttctcaaccagggacaattttgtccccacccccaaccccccagcatatttggcagtgccttgaaacatatttggttgtcacagctcaggggcgaggtgttactactggtatccagtgtgttcaacaggccagggatactgctaaataccctacaatgcagaggatagctgctcacagcaaagaattttccaaacctaaatgttagtaatgctaaagttgagaaaccttgctcagatataatgacataatgttgttagaatttttattttattcattttaatgtatgtatgtatgtatgtatgtacgtacgtatgtatgtatgtatttgagatggagtctttctctgttgcccggggtggagtgcagtggcacgatctcggcttactgcagcctctgccttccacgttcaagtgattctcctgcctcagcctccctagtagctgggattacaggcgcctgccaccaaacctggcaaatttttgtatttttagtgtagacggggtttcaccatatttgccaggctggtcgcaaactcctgacctcaagtgatccgcccacatcggcctccctaagcgctagggttacaggcatgagccactgcgcctggccaggaatttttgaatcagaatttttcttgttcgattttaatctcttatcatttagagattcttgaaatattgaaattactttgttcaaagtgaatgaattttcttaaattatgtatggttaacatcttttaaattgcttatttttaaattgccatgtttgtgtcccagtttgcattaacaaatagtttgagaactatgttggaaaaaaaaataacaattttattcttctttctccaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaaggtaattttattttctcaaatcccccagggcctgcttgcataaagaagtatatgaatctattttttaattcaatcattggttttctgcccattaggttattcatagttccttgctaaagtgtttttctcacaactttatttcttcttaaccctgcagttctgaaccagtgcacataagaacatatgtatatatgtgtgtgtgtgtatttatatatacacacacacatattgcatctatacatctacacatatagatgtatagattcaatatgtctaaatgtatataattcacagtttttatctttgatttgaaattaattttagattttacttgagaacttcacaacttcatataattttaaaaactgaagaccagattgtggaatcataaaatctaaatctaaatgggaatcacttttttaatctgtcctggttacctacctggagatttgagaagagtctttaaaaagaagaatccattttcttagggaagatctggattgccagatcagtctcaccacttcagcctctacttaaaggcattatattcccccgaagcaatgttttgttttagctgatttgtctgggggtgtgggacgtggtgttggttcacattccatttggttgaatagacatccagcttattccagtggcttttcataccgtcctactgtgatgtctgcttattactgattacttcccttggctgactgacatgctctgattgtgcaattggattaactttcatggttttagttttaggaaagcagctcttttggatctatttcattttagttgtcaagcagaaggtgaaaggggaagagaaattaatatttaatcattccctgttatgtgccaagtattagatacatttacagccactattttatttaatcttcatatcagattttgacaatggttgctattatcctcattttacacggtcacataatcaaagggaaatgaaattggtcctttatcaatgattcaggtgctttacacatgtaaattagagtccaatgtcaaacgtttatttctgtgaaacaagaggtttacacctgaacaagaaataaagtataaaaataaaatatggcgtaattcaataaacaaatatggagcactgactatacatccgatgttttactaggtatttgggattcaaaaatagaaaagagtgggaatcatttgaagatggttataccctagaacaatgaactcagtcttttcttggaaatttatctttcccaaatgtattgagtgtcatatatagtaatataattgataattcattcgaaacatatttagtggcattttcttattaattaatatgcatgagtctattttctcctgaaagaatctagatcagtgctttcaaatagaactcccgtgatgatgaaaatattctgcatcatccatttttgtaacgactagctatttgtgccttttgaatacctggagagttggtcgtgtgactgaggaacttgagattttattttagtgaattttgattaacttgaatgttaatagcgttgtatggctaatgggtactgtagcagacacagtaactttagttgacaaaaatgaagtgttaacaccatggtgattttggaggtcttgggaaagggcatacactatgtggtggtgaatgagttcgagaaatttagggatatgaagtaaaaaatgaggactccagaatgaaactacccaaatttgaaccacacctttgttgcttgctagatttgtgtcctgggagctggtatttaacccctttgtctcagtttccttccatataaaatgaagataattggatctacctgatataattattataatatgaagataaactaagataataaatgtgaaaaggttagcacagtgcctggcactgtgtatattgagagtcaatactctcaatgtcagttacctcttaagatgataatgcaatttctcagcagcaagctacggtatgctatggcatgctatgatacccaagaggctgatgaatttgttcacattgttctatttctgatagagagataggttttcagacactaactttatttggagtgttgctttaccatctcacatttttctcttaaaaaatttatgagggataatataatcgtttattttctacagagatttatctactgagggggtgagtgtttcagtcaatcagctctgtgctcagatagaaaactgttggtatttgaggtaccactgggccctcggtcaagtcgcttcattttgatagactaatcaatagaagcaaagacaaggtagttggaattgtgctgtaattcattttaaacgttgttgcatttgtctgtttcagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggttagacattaaccatctcttccgtcacatgtgttaaatgttgcaagtatttgtatgtattttgtttcctgggtgcttcattggtcggggaggaggctggtatgtggattgttgttttgttttgtttttttaacctgaccgtttgctttggctatatgttttgttgtggctagaaaaaatgatgatggtgaatggctttacattaatgaccaaatgccaaaatttataccacaattttttgcataaattattctgaagaatcagactgaagaaatggcgaagtatttaattcagtggccaggcatgtactgacagtatttaagctgaaaggacgtggtctggttctagttaaacaagtgtcataaatcaaaattaattattcacacctgtggtatggacttaataattaatgtacactaacgttcgccacaagtttatttatttacttacctactgatttattaacttgtgagttttcatctttccaccttgcatactatataaatctaacagtaatactatttattaaattaatacatatttattttatataaagcaagtggtacatatgaatttatagtaaaaagcaacatcaattgatccagcactattcattcaaagacaatcatttccccactgtattttcatggcatctttgtcataaatcaagagaacttgtatgtatgaatctgcttctggattctgtatcctcttccatttgattaaatctgtactttaacaacagtacttcactggcttaattacaatcttttttttaaaacaatcctaccgagctataattcacataccattaaactcatttaaagtgaacaattcaatcgtatttcggtgttacttttttaaggtgtgataaaatatataacataaaaaattgtcattttagtcatttcgtgtgtccagctcagtggcatttattacaaccatcaccacagtttatgccccacccccaatttttttttttcttttttggagacagagtctcgctgtgtcgctcaggctggagtgcagtggcgcgatctcggctcactgcaacttccgcctcccaggttcaagtggttctcctgcctcagcctccctagtagctgggattacaggcacctgccagcatgcccagctaagtttttgtatttttagtagagatggggttttgccatgttggccaggctggtctcaaactcctgacctcaggtgatccgcccaccttggactcccaaagtcctgggattacagcgtgagccaccgcgcccagcctccaaaattttttattactccaaccagacagtctgtaaccattaagcaatagttcccctttctctctcttcccatccgctagtagcctctggactactttctgtttctatgaatttggctattctagatcttttatataattggaattatatatttgccactttgtgtctgccttacttccctcagcataatattttcaaggttcatctatgttgtagcatgtgtcagaacttcattcctttttatgactgaataatattccattgtatgtatatacgcaatcattttatttaaacattttggatctggttgtgtaaaccttccactttgttcttcctattcaagattgccttggctacttttggttctttgaataaattttagaactatattgtctatttttacataaagccttccaggatattgattgaaattttgtgaatctggagctcagtcaacatctttacgatactgagtcatctaatttgtgaacattttgaattgtgtcaggttatttattgtattttttaaattggtgatgctgacattctaataacagatcatttacacgactgataaaatatttaggaactaaaataagtaccaattttatgacattaaaaccataatgtgcgcttaagtgtctctatttcaagcaggtagttatttgaaaaaaaaaaatcccttcttggtttctacctttaatgattgcaaaacatctgtgtaaagatacagacttttatgtatggagggaaggtggtgtcccagcaattaaattttatagctacataacaatacaaatgaaatcatccctcataaaaagagaacaaggaggaaggatacccaaaatgttctacaatatctcagtacatcttatgacaaaaagaagaacaaaaattataattgtaggaaatgtgagagaactatctaaaatatacaatagcagctttgtgggttgtgaaagagtcaaggttttatgtgtcctgcaacagaataaaaagtcaaatttttatgatagaaaattaaaactgaggttacgaacaccatcatgtatagacttatattactacagcatccataatatctgtttcctatgccaaaattataattttaatgcaatgtctttgccattaaatgccacaggatttggaattttattcattagtcatattaaaattatttaatcatcttttctccatccatatgcctctgtatccctgttagtttagatttagggatagaaagcaaatgatcagtaccagatttaggtaaataacacaagtttttttaaaagtaaaagaaaatggcttataacactggcagacagtcttgatcttcattaaatctcaagctcttacttattacaggagggtagaaataaagcggaccccctccctgtgtcctccagccctacccttcatccaaaggttagagtgggtgatataattggaactagtgggtcatagttactgtgacatgaatatgtcaattccttagtacatagtatctccaaacatatcctaatatcataatcagttggcaggtgactttctccacagctaactctaatatgctgcattctgcgtattgagccaactgaccccttactcttgtacctttattttatttttttttttatttattttttgagacagagtctcgctttgtcatccaggctgcagtgcagtggcacgatctcagctcactgcaacctccacctcccgggttcaagtgattcttctgcctcagcctctcgagtagctgggactacaggcgcgcaccaccacacccaactaatttttgtatttttagtagagatggagggttcgccatgtcggccaggctggtctcgaactcctgacctcatgatctgctcacctcagcctccgaaagtgcggggattacaggtgtgagccaccgcgcccggcctgtacatttatatttcattactgaagagagaaaacagcaggtgaagataatatagctatttctttaagggagtggtggacagggttgctttaaactgaatatagccattagcgtaaatttatgggtagcttcatgcaatgaaggctcatgaaatgatatcctcattcttgtctaatacataacttgaccttttacagcctttaacaatgatacccgtaagagccacaaagtggggatgttattaaagctagcctctgtgttcctctctctgatcatctcattctatgatcttcacccacacttctgactcaggtgtttttaatatttatccctcttcatatttctttgtattttctctgaacatgcatgtgggtgtaggaggctctctcgccatcatcatcactctcttcctctgtgtttctcacttttaggctaattttcatctatgaattgacacgtatattataggaatttatttttatatatttattaggaatcttctttttgttttttttttttttttgagacagagttttgctctgtcgcccaggctggagtgcaatggcacgatctccactcactgcaacctctgtctcctgggttcaagcgattctcctgcctcagcttcccgagtagctgggattacaggcatgcaccaccacgcctggctaatttttgtattttaagtagagacggggtttcaccacgttgatcaggctggtcttaaactcccgacctcaggtgatctgcccacctcggcctcccaaattgctgatattacaggcgtgagccaccgcacctggccatgaatctacttttctatttgcatatttgccactctttttctgccccagttgtttatgtaacacattctcttctgctctccttccctgaccccgttaatcccagtttcatctctttcatgtctttttattttgtgtcccctttcctcattcttcattgctctttgtatatgttatatgtgggtatttttttaactacccatttatttaaaaccaaaatatgctttatcattctttatttttgaacaccgagtcctagaaaggttatgtgacttatttgagaccatgtagctttctatttaaatataaaagtgattccaaaataaacagtaggggttttaaccttttggtgaagctcaagtgatttttatgtggataatatcctaatattaaaatggggatttattttcttttaaaaaaactatatgagtttttgctttggtttttgccctttttgagaactagatgctgtgttttaaaattactttctagaaccttctctgctgtggaacatttacagttgtgtaatatagcaaaacatgtttatgttgtttcagaattagttaaaatcctactatttttaatgtcaagtaattttacaggtggtgtacgttatgcattcctattagttttaataaatatgttgtcattttgttaaataagtttaaatttttcatcgcattttacatgtaaacagtaatttactatctacacataaaataccatttacaaataagatatactgtttatatgtaaatggtaaattactatttgaatttgttactgcccagacagtataaaatggtgcacataaagaaaaaagcattttggaaaacaattaagaaatttggctggaaagtgaattttagttaagtgcatcttattcactttaccgaggaaaaaggtaggtttacaaatacaacatatataacaaacctttaatatgggaataatttttgtaatattgataataatacaggtattattttcaaaaaatcaccaaataaaaattatgaaagtaaaaatacagtgcaactcctagcacaaactatcttccacaatatacagttggctgtatctaaatttccagaaatctggttcattttgtattaatctctaatcatgttgcttctaaatatgtatctgaggagtaaacatttcagatttattttcatttgtataaggtaaatgaatgtttagtctttttccagacgtatttgctatgtaatgacagtcattattagtcgtcagtataaatgtgaatagcaaaaaggagaaaattaaataaagctagagcttggctttccgactccttgctcaaaaatggacactttgtccaatcaatttcctatcacaagatgacgattaatagattgttctaatagttaccattcagtcctgcccttaacgtgatgttttttcaaccaaataatagaatcttcactggcattgttaccatattgactggtatttatggaaccccggaaaaaaaaatgctgtaaaatatatagtaggaagtataataatcattataggaaatcatttctctagctggaagtcttagcagggaccagatagttccactggagcttttatgtgctcatgattttctcccttgaagtgtatttgtaacacagttcacacagtttttaattttataaatctgtgtgctaaaacgctattatataagaaaacgggccgggtgtggtggctcacgcctgtaatcccagcactttgggaggcccaggcgggcagatcacaaggtcaggagatcgagaccatcccagccaacatggcaaaactccgtctctattaaaaatacaaaaattagctgagcgtggtggcatgtgtctgtaatcccagctatttgggaggctgaggcaggagaatcacttgaaccagggagtaggaggttgcagtgagccaagatcatgccgctatactccagcctggcgacagagcaagactctatctcaaaaaaaaaaaaaaaaaaaaaagggtgttcacctatttattgggcatatagtctgatagttcccagaaacccattatcttgaatgttttctttatgtaagttcctggaaatccattatttggatgttttctttatgtagttaataattacagcaaagctgtaattaaattatttattcaagagctatctattaaaggactactatgtgccacattctgttctaagcatatcataatcacttcccacccttcccttatttaaaggacatgcataattttatagggcttggcattataaatattcatatctctaatttatagttgctaaacagtttgaagctgagggttgggggaagggagtagtaatttaaagtttataacataagcatccttgactttgcctcctataatttcacactgacatgaggtttattactaggttgtgtgtcatgagtacatctcaatttgctctgactgttctggtttttgcctgttatcctatcataatttttaatagctccctctttcattgtcataagtattccactttagaagataaaatatatagagagggtcactctagttatgagaacaaacatcaggcttttagagctaggcttggtccagtgctcaataactattattatcatgattgcttttgttcttagtagcatcatcgtccttgtcatcatcatctaccttcctaatactttagttcagctgagaatttcggcctatccaagaaatctgattgccattattaccgaattaatcactctttaatgacaatagtatataagaatacgtgacatttaactttccaaattattgaaatgttacgctgtgtatggaaaattctttctaaccgtgttttttctctactctcaaatcgtaacaatcgtcaacacagaagaagacttttatgaccaaatttgtggaatttttttccccatacaccaaacagcaggcaccagctgggtgtctctaattcagtcctgacactatccacccagagatagtgtcagatcccatagattgagggctcagtaccgaggtctgcctcctctgcacccccctagcgcacgcgcgcgcacacacacacacacacacacacacacacaccagtctcaagtccaggcctctggaacttctgacccatgggcttcaagttggggttcccatgaccctctctttgggttcaactaacttgctggagcagctcacagaactcaggaaaacactcgctttcacctgtttatgataaaggatattgcaaaggacacagatgaagagatgcatagggtgaggtatggttggggtggagggacggaaaggggcatggagcttccatgccctccctgagtgcaccaccctctaggaatccccacctgttcagctacccggaagctcactggactctgtcctctttgttttttatggaagcttcatgacatcagcattccttccccaagggtatatggtgggaccctctaacaggaggtttttaagacctataatctgaaaggcgagggaacattaaagtgaaaggagagcaggagaaggtcagaggcctgcccctgagacccaacgcaaccaacattataacaaaaaactgtaacaagggctatgggtgttatgagccaggaacctggatagaaaccagtatgtactataataccatataggcaatgccaagaatatggatcagacactttacaaacaaggaaaaagtaaacaggagtgatgaggaggtaatttactgcaggcattaatgatgagattatgaattatggattccacttgctaccagctatgtgatcttatacctactctgtccatacctaagttataacatccataaaattcaaatactaaaagaagacacttccccaggttgtggtgaaaattcaatgaggtagtaaatgggaaatgtgtaacacagtatctggcatattgtaattgctcaaaaaatgttagattaaaaacagtaggagtaatactaaaatagaaaaatgcaaagagcaagcacaaaatcatctctgattctcacctccaaattctccaaaagtctcaccttcttaatcaaagttgtaaatatggctcttggggagaaagctgaactatgtgctactattatgaatgcaacaggtgaaggagaggagagttagaggcagcaagacaaccaaatggctctcgtggaaggcacagaggattttcagccactgctctcctattccgctgatattactttcattttctatgaccaactagcatttcagctaaaatgtgttggaaaatgatagatttttctcctcctattgcctaagaagcccaacaaagccagcattgttttcaaacaccagcattctcacttttaaagtatgaacataattcagaggacttttaattctgaacatcgtttttatcaatctattggcctgattgtaacccagaaatccaagcagaaagcaagtaaactttcacactgcttccccatcccttccccctacctttatttttgacatcagtttccctcattttggcaaagtaaaggaaaagcatttgtagaaggttacactgaagctagataattttctattaggaaacctcaccaaatacaagataatttgttcattccaatataataatgttttaaaaaatataacaaaaatccagcataaattgtgaagcactgatacttgtgtaacaactaatttccatagtgaaacttcattgttgccactatctacatactgaaaatgtatatcaagcatgtaaatgtgtcacttaagtatgctgtgccctagattttatttaaaagttaagctaattttcaactaaaaacaaattcgactattcttagcaatctctcctccccgttcatgatggatttaaaatgatgaagagtataaatgatgatgaaaagagaaaggaggagaaaaatttcataactctgcatcttcagtgtagcatttttaagtaactcctttattagcacaaaggtgtttgcctgaagcaatgacttctagaaaggagaagaaatgacataataaaaggggattttgctaatataaaatgttttttctttccttttgtttctgcaatgcttttacttacatagcaccaaccctgagactagagggagtttccttcctttctaataatttaataatcgtgaaatgatattaaatggaagttttcatatgccaactccttaaactgaggttaaataaggaacaaagattaaaggccatatttaagaccacatattgtaaattctaacccagtttcatttattatatcacctgcaaagccaatatgccatacaaaagtaaaataacagggtgatttttattaaagatcagaatcataccaaaaatgaacttttctgtcaaatctttatactcatacatcaagatgtgagtttatttatgtagctaaaataacttaatactaaatgctgactactatattcatgtcagctgacccctagtgcttcaaaccatagaaaagggataccaaatgctgggttggttgtgtattccatttttgccgtataccacctgccaaggcttataacagatctgtaatgggtttcttaccttttattgtgtagaaaatggattgttggattaggcctggggccagtgaaccatggaaccccaggtttgcaagaaagagtttatcaccctttgatgttatttctgtctcgtgtcagctgagaaggatgagctagattatctgaaagtaagctggatgccaaaatcagcattcccctcatttatccaccttatggttcggggcaagaccactgtatgggtaacaaaagggctgataagggcctgatggagaaatttggtttttctcccttttgattggcttgctgatattagaaccaattacaagacattgacgagagcatttcattgtttgttgctagagaaaatccatcaattttgttgtggaaatgaaagcatttgagctgaatgttgcacttataatttgtgaacattttcagttatcaccgggacaagtatagtccatctttggcatggttggccaagtgtggtgggaaaagagatggaccagcaaatgggccggaaaccaaagtcatcaaaagggtatttcaagaaaactctatttgttctgatggttacattctgcaggcaacctgtgactgatgactgatgcttatacctcaaatgcagtctaaaaatatttttttgtgaaagtgacacattctgactgtgatgtgggtgacatcaacagttttgaataggacagtacttcttggacttattgaaacttttataaaagaatgaacattctgaactcaattgcaatgtaaatgactatcatgaagattgcttctgttggtgctatgacttttgtgacaaattttagaccattgcagttatctcctagaggttgctttattgttttattttcatcagtgatgtgtattttatcagtgatgttagaatcactgagctgctggttaaggaagagaaaaaaattaatattcaggtgctatataggcccttattcattgagaacaaataaaggccaacacacaaaacaggaaaattaatagaaaagacactctatgggtaagatttcatatagtttgggagcagacaaaaactattttaattactaaaataattaagaaagatgttgaggctgggcacggtggctcacgcctgtaatcccagcactttgggaggccaaggagggcaggccacttgaggtcagagttcaagaccagcctggccaacattgtcaaaccctgtctctactaaaaatacaaaaattagctgggcgtggtggcacatgacttgaatcacagctacttgggaggctgaggcaggagaatcatttgaacccaggaggcggaggttgcagtgaaaggagatcacgccactgcattccagcctgggcaaccgagtgagactctgtctcaaacaaacaaaaaaaaaaagattaaaaaaaaagatgttgacattaacatgttcaagtctttatgctgaaactagaatgcagtatgattaaataatcatttctacttcgggtgaaggattagttttcttaaagatacccctttccagcttctcagttcgcgtgtggttaattcccaacgtggcctcaaatattctaatggtttgtgtaatgagtgccaccgttccaccttcttattctccatgcctcatctcagtcctggaaagatcactaaacttgcagttcataactcagtctagacccaggttcaacactcactaactcataactgtgggccacttatttaaatctcttagtgcctctagttcctcatttgtccaacagtgatgcattatgaagcatgtttgcccatctcccagcgtctagtgaggaactaaaaacacaatatatactatcatactttattacgaggagttaaattgtggttactattacaaagtaggttaccataaaattctaatagcagtggtaaggggtaaagatccacgtgccatcacgtagagcagaacttctcaaactttaatgtacggcaggtccttgaataatgttgtttcattgagcatcactgtgttataatattggcaagggaaaaaactgtatctcagctaggggggcactgtctatgtggggttttcttttgtctctgtgggttttcttctagtactctggtttcctcacatgtcccaaactgtgcacgttaggggaattggtgtgtctacattgtccccatgtgagtgtttatgtgtctacgactgtgccctgcgatagaatggcatccctgccagtgttggctcctgtctggtgctctgagttgccaggatgggctctggcctcccaagtccctgaactggaatacgtggcttggaaaatgaatgactgaattaatataaattactgtgaaataaaaattcatatagtattcaataatcataaagatgcgtgacaataattgatgctctacagaagtgctcagtgagctgccatattgattattgtttgtttttgaactttgtggtgagagaaggcaatcctggcagtttatgctttgcaaacatttattccttgaatgaaccaccgccactgcaaacactgtcactcactgattcaccaaaaactgggtaaataattttcctcctggtttttattaatctttctaaagtggatgtatatctcacatttatttctgagtttaatattagaagtgcttggggtctttatttagatgttggatcatgttttgtgaacacaggtatgcagtaggaacttaattcttgtttatcaattagcctatggtaagattggtttcattatatgtcattttgcctaagtcacagtttcccagaatctatcaacaacattaattgatgacttactgaaacaggaatcaccttgagatcttgttaaaatcaggttactgattcaatggctcttgcataggacctgaggttctgcatttccccccctaatttcaagatgctggttccctggtccccttgctctacttcttaaatggtagggaggtagagagtggctatcaagagtctgtgtaggagttgaccaccaatcccattcaatggaatgcatacagtgtgttctgagatactggaaaggcctttgcaaaaagattttgtctcttgatatttatgaagcacattcatccgaccacagaagatacatatcaactttgacagaaaatatgaacacattcaaatgatttatacctttgaaacatagatcgttgtggggttcataacccaagtataactttcccacagattcactcaatttccttcctctttctgtgcaatatattgtatattgcaagaagctcacctccactcaccttattcctcaggctttcttctcaactatcttctgtatagatttaaccagtgggaggcgttggcaggagattggagagcaggagaaggggagatttcagggtatttctttccctctttcactgctttgggcaacagctgatacagagtaagtggccaaaaaatactagctattattaggtcttctaataatgatcttctaaaatcactttttcagtggttacccccattgatttgccatgaatgtctcttcagacatctttgcaaagaattgagcctgactttagatactcattcaaaatcaaaatcagtaattttaggattgaggactctggtattatttaagaactcttaactgtaccaagcctcactcccatttctggctttcccctatatatcagttaagtaataactccaatagtgtaaaatttgcaatagtgttatgtaacaaatcaccctaaaacttattgacttaaaattatcaccatttataattgcacacagtctgtggggtcccgtgagctgttgtgttgttctggctcactcatacattttcagtcagctaatgggtgggctaggggctggcttatctagcataagcgcagctaggatgattcacctctgctccatatggtctctcatccttcggcaagcgctcctgggcttattctcatgcaagaaacaggattctaatagagaaggaaacaagacttcttgaagcttaagcttggagctggctcactcatttctaacacatttttttaaccaaagcaaatcacaaggcaggcccatattcagggattagggaaataggttacaactcctgatggtagcaactttaaaagtcacattgcaaaaagatgtgcatacagagaggtcaccagtgcaatctaccacaccttgcaatctattaagtttctcaccccctcacaagtaaggtattcagttaagatgcattcctatgtattcagatttctaatcaactaatcctgattctcacgtaatattgacacagtatcaatattctcaaaagccaatagtctagagggtcacaaagatcctcaaagatactttatgcaaaatcctaggagtatagaaacagtaccttggtttatgtatacattcagtatttattaagtgtttccaatatggtataatgttaaggaatgaggatagagttatgaacagacagacacttgtctttatggatcttacatttggagggggacaaacattaaaatggattatataattacaaatgcagccgttctcattgtcttttcagatttctcagggtgtagactgagctactataataaaaataccccaagtttccatgtttcaaacaatatagatatgtgtatctttcccacataaagtccagcctaggtacgtagtctctgctctaaaaaggaacacaggctagcaaggcagctatactattctcaatataatactgcatttcaaaatctccatgctggtcccacaaatatccatgcactctctttcttatcatcaagagaacacacagtgccttcccaagagagaccagtcaaagtctcattcacttactgcatccagctaaaagtccattgtctgtggatgatgcactgtcttctccatcagatcaagatatggttcctcatggtccagtgacctataaagtgaaagttatgctatctgctcctaccacaaccaattctctctttttaaaatttttttaaatttttgtgggtacatagtaggtgtatgtatttatggggtacttgagatgttttgacacaagcatgcaatgcataataatcacatcatggagaacgggggatccaccccctccagcattaatcttttgtgttacaaacaatccaattatactcttatttatttttaaatgtgcagttacattattttgacgatagtcaccctgttgtgctatcgaatactgggtattattcatttttcctaagtattttttgtacccattaaccatcccgctgccccctccccgactcctccactatccttcccagcctctggcaactacctttctactctctatgtccatgagttccattgttttgatttttagattctgcaaataagtgagaacatgagatgtttttctgtgcttggcttattttgcttaagataatgacctccatttccatccatgttgttgcaaatgacaggatctcaatcttttctatggcagaatagtactccatttgtgtatatgtaccacgttttctttatccattcatttgttgatggacacttaaattttttccaaaccttggctattgtgaatagagctgcaataaacatgggaatgcagatatttcgtcaatatactgatttcctttctttgggtatatacccagcagtgggattgctggatcatagggaagctctatttttacttttttgaggaacctccaaactgttctctatagtggttgtactaatttatattcctaccaacagtgtgcaaggttttccttttctccacattctctccagcccaggcacaaagacagcagtaagtgctggacgaccacctatgcaagacctagactataaatccagtacttctctccctctccacacccccatacccaccactccattctgagttttcaaatgtaagctaagctaaatgattcaataaagctttttgaagtcaaggatgagaaaaatcgttgctttttatgtaatcccaccatcaaagtaataattgcttagttcaaattgtggtgatgcaaacaaggaaagcaagagagcataaaacgggtggatctgacgcagtccagaagtggaggcaatggttgtttttagataattattagagaagatactgtgatttggtttgaaggcaaagctcactgaagttctctagttctagatacacctatcgaaaaattcttacccaaataaatgtctcagtgataagagcagcctttccccaaatgcctaagtgtttttgttttgtttttgttttgttttgttttgttttgttttgtttttgtttttgttttttttcaaaatcttcctctggaatggatgctgaccttgtcattgacttattcttcaccacaactcagtcatattaatcttgaaagagacagagaggccactatctctgctaataatttacataattgtttttctacaatttggtgctaattaaaatgtgaaaggggtagtgatgatataggtaaatgtaataaggtcattctttgttcctgagagcaaagataatgtcaccagaaaggattgtctgtatattcacataagagcaggaaacaggaagagagacacagtaaggtaaaatagcatactagtatatcacgtagtctggtatagccaatgtagaatatttatttcaaaaaacaaataaagataaagttctgcttcactttgagaagctgttttttttaatcctgtatagttagttcgacatgttactactctgcctggttcaaattttgatttcactctgttccagttatatatgctatgcaacaaaccactctaaaagttactggcttaaaataagatagttttacgatttctcataattctgagagttgactatgatattcatctgcttcacctgatatcaaccaagacactgggaaagctggaaagtccaaaatggcctcactcacatgactggcagttggtgctgcctaccagctgagaactcagctaaagctattggccatgagcctcagtttgtttccattgtcttctccatgtgtctcctttggcttccccacagcttggtggttgagttctgtgaagaagccttccaaaagaacaagcaccaatcttcaaagacttatcaagcttctgtttgtatcacacttgctactatcccattggccaaagccaggcatatggccaagttcagaatcaaaatgagaagggactacacaaaggcatgaatccaagaggcgtgattaattgtggggctgccaaataatcgccttccacaaattccttactagctgtgtcatctctctgtggtctcagttttctcacctggaaacaggaacaaaaatggccctacaaaaatggactgagatatattaggttggtgcaaaagaaattgcagtttgggaccgtgaattttaaatcattataactaggctcaagcacatctttattaatcaaagtaggaaccgttacagtcaacacatttttgccaagaagaaataagtgtgtttattcctgtagcataaaaattcatgctttgggattcaatgaactcttggaaagcattttcttcatcctgctagttgtggaagcattttccctgtaaaaagttgtcgagatgcttgaagaagtggtagtcagttggttgagaggtcaggtaaatatggcagatgaggcaaaacttcctagcccgattcattcaacttgtgaagcgttggttgtgcgacgtgcggtcgggcgttgtcacagagaagaattgggccctttctgttgaccactgctggctgcaggcatggcagtttttgatgtatctcatcaatttactgagcatacttctcaaatgtagtggtttcgccgggattcagaaagcggtagtgggtcaggccagcaggagaccagtgaacagtgaccatgacttttggtacaagtttggctttggaaagtgctttggagcttcttctcagtccagccactgaactgggcatcgccagttgtcgtttaaaatccactttttgttgcacgttacaatccgatcaagaaatggtttgttgttgttggcgtagaataagagaagatggcacttcaaaatgacgatacttttattttcgctctgcttatgaggcacccacttatcgagttttttcgcctttccaatttgcttcaaatgctgaacaactgtgaaatggttgacattgagttcctcggcaacttctcgtgtagttgtaagaggatcagcttcgatgattggtctcaatcggtcattgtcaacttctgatggccagccactacgcccctcatcttcaagactcttatctcctttgaaaaacttcttgaaccaccactgcactgtgcgtttgttagcagtaacttggccaaatgtgtttttgacattgcgagttgcctctgcttctttacaatccattttgaactcgaataagaaaaacgctcgaatttgctttttgtctaacatcatttccatagtctaaaataaacataaaataaacagcaagtaataagtcattagcaaaaaaaaaaaaagtgagaaatgctcattaaaatgatgtataacataatcacatttatttaagaatgtatttcaatatcaaatggcaagttccatgaatgtgaaaacaacacttacttttgtagtcacctaatgacacatttaagaagctgaaacctgagctcagcacatggtaagacatcagtaagtattagttatcataatttttttagtaattttcctacagagctataaataaaatgaaatactttccaaacagtgataaaactataaagcagcaatacattataagcttctatcctaatctgccttcccctcagggccttaaaatgtgtcatttctgtaaatgttacctctgacatgaaagcaccaacacactgttcagcaattacaagttgattgtgacaagagcctcactctccctatttctttttctcttcctgtcttgctttcccttttccccatcctttcactcactttgataaggcaaactgccatgtagtcacaaaatcctagacaaacaagtctgtacctatgtgggcgatgctgtggatttagtaagggaaacagttccttgataaatttctcctttagccctgggtttccaacccctgtgtcattcagctatagaaatcttctgatattttctcccactggtcattttcactcaggctgccatcaaaatgagactacccaatgttctttccatttgttctgttttcttcctcgcctctgattccctgcctggtccacttagaaagtctaccttttttccttctctcttaataccaccaatctctaaatctgacttctcctttctaatcccatagagcctgccttgtcatctccaaacaagatccatcttggcctcctgttatcctcagcccacagcagtatttcacttacaacgttcgttagtttctacctcagatgtgtcaggcatttagtttgtaccaatattttatttctttttatatctacaccaagcctgcactagacggtccaaggagaaatttaactgattcctgttttgaagtcctccccactccttgggagagttaaagattcctcagtgtgttaggtaatgatagttaatatttattaataacttactgtgtatcgactgtattctaagtgctttgcactgttagaaggagaataacctaagactgtgccaaacagcagtctagaacaaagctgaattccttgcttgcctggcaagggagaatgtggtacatactaaaggattaatacatgttcactattaaattgattgattgtggtggtggtgacagtggtgatgacttttcaagtgtgggtaaagtaattttttccaacaaatccacatccacatatttaagaaaagagagacatttcattctatctttttgtgtgcctttgagaggacacccctggcacccaactcccaggcaaatgccaccatctgtgtgattttccttcatttgccaacgaaggcacagcaggtactactaggttaacctttgctttcgcaagtcttctctcaaaatagtaaacacttcagctgttggaaagctctaatctcaaactgcaaatttaaaaatctctctctggagttcaaaaaatagaaagaaaaaataaaaatctctctcttctggaacataatgtttgaactgttacatattattcacactatttcacattatgggattatgaaatatggttttaggtgttagaaaaacgaaagaaaactattatttgttaacactaaccgagagatttttatgatattcaagtaaaatgatagaatgaattattttaaaaatgcatgaatcttcaccttctgtgaagtgtcatggaggattagttctaactaatatgcctgtaagtaactgacttaatgcgtctattggttctcttaatgctgtaagtgacagaaaactggtctcaaactgatttaaacaataaatatgatcaaggttccggttttttgtttcttgttttttttttttttttttcacatttctctgggttctatttttctgtgttgacctagcagcttcacctgacttccctcttggtgacaaaaatggcctgaagccgtttcagaacccacatctgcaaacttacttttgatgaaaatcatctctttagggaccttctttcccaaagcatccaggaaagactgctctgaaactgactggcctgaattaggtcacatgctcattcctgtactaaatcacacctcacttctacagctaaaagtcattaaatctcaaccaaactctacagctgcaccacaacaaaggtagagaagtaggtgcaaagttcctcaaaggaacgtaagggtgaaagatgattgactgataaacagacaggtagacagaatagatagatgaattaggaaaagataaccaaccaatatctgtcacattgctttgacttgattttttagtcaattaatgaaactgaatggtaattttgacattacaacaatactttccaaatgtaggcaggttgtggagatcatttaaggaaaaaatgtatgaggtgttgtagcagatactgtcggtgccccaccgatatccctttagcacttaccatttttatacgtgcttcttaatttccaacttcctgtacttgcatctctttgcttggggctatctctgctcattcttgggagagagcagaaatgtagcagttatgcccctgtagagcagcagttgatagatcaataccctgtcccccttgcccttcagatctaataactccaagcttaattccctacatctttcatataagtatatatataagtatatatatatacttgaagttctagggtacatgtgcacaacgtgcaggtttgttacataggtatgcgtgggccatgctggtgtgctgcacccattaactcgtcatttacattagctatttctcctaatgctatccctccccagccccccaccccacgacaggccccagtgtgtgatgttgcctgcgctgtgtccaagtgttttcattgttcaattcccacctatgagtgaggacatgcggtgtttggttttctgtccttgtgatagtttgctcagaatgttggtttccagcttcatccatgtcccttcaaaggacataaacaactcatccttttttatggttgcgtagtattccatggtgtgtatgtgccacattttcttaatccagtctatcactgatggacatttgggttggttccaagtctttgctattgtgaatagtgccgcaataaacatacgtgtgcatgtgtctttatagcagcatgatttataatcctttgggtatatacccagtaatgggatggccgggtcaaatggtatttctagttctagatccttgaggaatcgccacactgtcttccacaatggttgaactagtttacagtcccaccaacggtgtgaaagtgttcctgtttctccacatcctctccagcatctgttgtttcctgactttttaatgatcaccattctaactggagtgagatggtatctcattgtggttttgatttgcatttctctgatgaccagtgatgatgagcattttttcatgtgtctgttagctgcataaatgtcttcttttgagaagtgtctgttcctatccttggccgacttttcgatgaggttggtttttttcttgtaaatttgtttaagttctttgtagattctcgatattagccctttgtcagatgggtagattgcaaaaattttctcccattatgtaggttgcttgttcactctgatggtactttcttttgctgtgcagaagctctttcgtttaattagatcccatttgtcaattttggcttctgttgccattgcttttggtgttttcatcatgaagtccttgcccatgcctttgtcctgaatggtattgcctaggttttcttctagggttttatggttttaggtctaacatgtaagtctttaatccatcttgaattaattaatttttgtataaggtgtaaggaagggatccagtttcagctttctacatatggctagccagttttcccagcaccatttattaaatagggaatcctttccccatttcttgttttttgtcaggtttgtcaaagatcagatagttgtagatgtgtggtattatttctgaggcttccgttctgttccattggtctatatctctgttttggtaccagtaccatgctgttttggttacagtagccttagtttcctacatcttcttttagggataacagggagtattaagattcagttgttcacattgatgacttgcatgataatataccctttattggctatcttccctatttcacttcttctcaccctgttgatgtgtcctggaatcacatcccaaaactacttgagctcaaatttttatttctgggtttgctactgggagacccaaatcaagacagttggcttcagtactcaggtacttacaaggagatcatggatatcaattgaatcagaattccatgtcatagcttttcaaatttatatcacaataagttgaaaagatgttgattcttccttccacagtattttctgtttctgtgtgtcttacattctggtgtctcaaaacatggctgcaaccagggaaggaattgaaatttggagtaaatgtcctattttagtaggtctacatttaagacatggacctgaaattgagatcataaacaaaagtagatgtgagcataaagtagaaggtgaggttggagggggaaattgtttggatttactgtaaccaatggagctgcttagtctagtcaaggaatttcaatcatttctgtggagactagatgacttatgttatacaaggatatctctggaaaattcactgtacagttttactaaatctggctgataatatgttcactcaatgttatgatgtcaataatagaatggatattgcctttaaagacaattttaaagtaaatatctcacatattcctactcatttatcaagggctgtgtcattcatggcaatataagataattcttttcactttcaaaatcttccagatgcagaaactttccaatatttgctgtagatgaaagtgtacaatttcacaattcaatgggacaaaaagaattaggaaaaatatgtttcagagagtttatttggtatcatctacaagacctggtatgagacctggttggtgttgtatggaatgaaatatatcagtctgttctcacactgctaataaagacatacctgagactgggtaatttataaaggaaagtgatttaattgactcacagttcagcatggctggggaggcctcaggaaacttacaatcatggcagatggggaagcaaacaccttcttcttcacatggcagcaggaaggaggagaatgagcaaaagagggaaaagccccttataaaaccatcagacctcgtgagaactcactgtcacaagaacagcatgagggtaaccgcccgccgtgattcaattatctccacctgatccctcccaggacgtgtgggggttatgggaacaacagcttaagatgagcttttggtacagacacagccaaaccatatcatagagtttcgaatctgaaaaacaaaagaagctaatttagtttcagaaagctgagatttcatgaaccatttaaaaattcactttataatttttcatgcattttgaagcctttatcctttaaatggaaatggaatagaactattattcgtcatttctaaactgtgcattcatcaacaattttcagaagttaattccaacatgtcttcatcaactctatattacatgttagtacactacatctctattttcatgctataattttttactttttcctcacactttcatctcaccctctcaagatgtgttaatcccctttgctcttttccccatctcgtctctgttgcctttctccccccttcctttttttttaatttctgttctcttttacctgaaatctccctcttcatcttttgctaccaattatgttcttaattggttgaagtgagcaaggtaggaaattctccattttgattccattctctcacatggtttatctttaatatgttttaataaacagtttaacataaatcttacttccaatttaacatgtaaaatttagaaaattggtgaaaaatatgcctgctttttcacccccaaagaaccaagtttaaaaagttttgtgactttgaggcatccttttccctaaaagcaagcttaacagattcttagcattcgtctctgtgtgaaattgtggaaactttaaaaaaactatttgaagtaccaacaactcaaagataaattgtctgttttaaatgcaaggtgctaaaataaaactagaagattgacaatattattcatctttatcactgttctacttaaaatttgaaaattaatgttagaaatgtgagagggtgcatgaaaccttaatggttttatcatttcatctgagtatatatttgatttcttctttctgacattgaaactttaaaattcgccactatttttcagtaactcgttaaaatatggtccgttcttatatttgcaatactcctatactgaaaaccctacaacttcaccattatttaatttttatgttactatatttgtttcttaaaaagattataatattatgtattagttgtctattgctgcataacaattactacaaagataggggcttaaaactgtatctttagagtatcaggatacatatgggtcagaagtctaggcatagattatccatattctttgcttcggggtctctcacaaaggctgcacactaggtgttggccagggctagggtctcatttgaaagcttgccttggaaggacctgcttccaaactcacctgttgttggtaagtttcagttccatgtgggttattggactgtagtcttccttttcttgttggctgatggccacgtttagttccttcggtctctaacatggcaatttgcctcatcaaaatcagtgagagaaagtgggggaggggggaaagagacagagaaagagtgaaattgctagcaagacaaaagtcccaatcttatgtagcctaattggagaagtgatatccttttgtctttgacatattctgcttgtcagaagcaagtcaaaagtcttgaccactctcaaggggaggaaattattaaaggactcaaatactaggagacagagatcactgagtgccattttagagtcttcccaccacggattatttcccttcacctgctggcatttgaaaatgcagctaatactctgggattctccaaacctaatttttttgtataattagagaagtatttgtcataatctgttaagtgtagtaatatattaagaaattgaatttattccttcatatttcaaaaagtacatggggttgggggacagctatgttgtcataaactttaatacatacatgattggaatggattatgaaatatttttctctaagagatagtataaggctgcaaccactgaggctcccaaatacagatgattcatatgtatttagttttaatgcaaagcttctcatgctgatttaaactctcatattttcatatatggtgttttattttttatataatgaatgtctataaaattcctattattttttcaaaagtattgtggcaaatatttcctagtaaaatctaaagatatctttgacgtaatttttatgctctcatttatgttaagaactcaatattgaagtaatgttctttcttatttcctagtaactaaaatccttactatattcatgaagagctgtgcctctattaaaaagcttttattgcaaacagaaatgtcaaaatacagcaaaggtagagctatgtatgattcttcatctgtaatgtaattttaagtatacattttattgcataagcagagatttatacccacatttgctttcagtattcacagaagaattttcatatgtatttcttaaaataacaaaatggctgctttggtgtggggatagtatggtacagcatttattgtgaaaatgattcttatcttccatctttttcaaatggtgagttcagtatgtttaacattgctggttttataatattgcgaatatttttgagaggaagaaacaataagagactgataagaataattcatatttgctcaaagtttaatcagttttttatttgaacaaaaacttggacgaaatgtccaactttcctttgagatcagtgctctccaatgtggtaacaacagcctaccatatgagcatttgaaatatggctagtccccactgaaatgtgctgtaagtataaaacactcaccaaattacaaaacctaagtatgaaaaaaataaaatatctcattggtactttttatattgagtacaggttgaagtgacaacaatttggctatttaagttaaagaaaatataacattaaaattaatttgacctgttttttacttttgtaatgtgtagaaaattttaaattacatgtatcgctctcattataattttattggatgtcattgttctagataaacaatggcaatgttgagaggtgtcataatagggacaattgtctctgtgaagaagaaattatatgaaccctacaacatgtattagccgcagagttgcttagaattgacttactctgtcttgttgaaaataggttttcccttaaaatctctgcctgatgtagccaaccacgattcaatgagcaaacaaaaatcttaaaggggaaaaaatcattttttgagtctattttacacacccagtatcaaaaagaaaaatataaatccacaactaggattatacgggatgtaattcttggatttcttttggtcttataatgctttatacctaggagatgttcaacaaattattattgaatgattgtagtttaaccgtcagttacattttgcagcaatacatttattagtagcaaaatctgagtgtttactaattttcatcacctaatcagcaaattagtactgctcttatatcgctttgcctacgctctactcactggttcaatcagctaattttttcagaattttatggtttataaaccactatatgttgcacagtatttcctatacattagctcatttgagtcacagaagttataggaggtggatcttgtctttctttgttcagaaagagaaatccaggttcagcgaggttaactggccttgtttaagatcagcacgttgctaggtgacagaaggtgttcacttctcactgaactttgcatatcaaaagagatttaaagaattcactttggagagcgggagttatggggtgaatattttatcatgttgtccgtcttaataatcaccaatttgatactaaggctgctagtcatctctaacgaagagaagttactttgaagttggttgattgattgttgttgattgacagaagtattagttttcagaatgaactaattcattaaagaaataaaacattgggtttgttcattccataaataattgaacatttattatgtgtatgataccagcctaagcagatacctaaaaggaatggagattactatagttaataacaatgcattgtattcttgaaaattgccaagagattacattttaaacattctcaccataaaaaaatgataagaatgtggggtaatgcatatgttaattatctcaatttagccattccacagtgtatgcatatttcaaaacatgttgtacacaataaatacatacaatgttatgtgttaatttaaaaataaatacattagaaacggtaaaagtcactaggatcatggaaataaaaatgtttacatttatgtaaatattagtaatataatagagggcatatccaaaatatagtgtcatattaataagatgttgtatgattattatagactacaaaataataaaggaatagacagaatgtttctaaataaagaatagaaattacagtgaagcggaagagagagtaaccctaaacccttcataatcctccctttgcctcgtagtatagcttggaaagtaattatgtggaaagttgagattgcaacaaaggacggtagtacaggagttgcccaaggacagacaattattttctcaaataaactatagcagaagcaaaatggccttggaccacaaaagaaggccctcatgtagacattgttctattctgaagtagaatttgcagtactcaagagaagaggaaagattattataggtggagagactgtaaacaaaatattatggtaggattcctcctgaatagagcaaggtgattgtgtttgacattgaaaaggtatgtttgggcaagagtttgaaaacctttagccaccatgctaagagatcttaaatctttatctctgagtaagggcggtggttgtggttaatgatccttgagcacaactctgtcccattaaagacagtagattcaactgcttctagcattagtccatatcagggagtaaagtgatccgatacattattttcccccagtaaatggttcataaaggaaggccttggctctgccttgtatgtctacatgggagaatataccagaatgtctagaggagcatgggtagcgtaacctttccccatatgcacatacaacaaatactgataatccactcacaggggagggactcatttttaagaattaagttttattttagaagactcagtctgatggcaatgcaggggttgaattacagcaggtagagactggaggtctacaaactggtttgagatatatattttttccggtggcccagataataaggacttgaacagacttcttgctctgggaatgtaaaaggccaggctggatgtaagaggttaggaagttccaaactgtcccacattttcctttcttctgagccctccaaactgtaccagactctgcatgttacgcacttccaaagtcgcttccacattttcgggtgtcttttcagcagtgccccactctactggtaccaaattactgtattagtccattttcacactgcggataaagacatacccgagactgggcaatttacaaaagaaagaggtttaatggacttacggttccacttggctggggagacctcacaactatggcaccaggcaaggaggaacgagtcacatcttacgtggatgggcagcagtcaaagagagagcttttggagggaaactccgcttttcaaaaccatcagatctcatgagacttattcacaatcactagaacagcacaggaaagacctgcccccatgattaaattacctcccactgggtccctcccataacacatgggaattcaacatgagatttgggtggagacacagccaaaccgtatcagtgatgcaaaataaaagaagactgtggagtaaattacacatggagaaaaggaagaggaactaggaagtatagatactgtgagaattaactctctgttctacaaaagaagaaatgggcttaaagtggttccccccaaaactaaaatccaaaggcacataagtcataatgcacactgttacaccgagtccttccagctcttaacttacttgttttactgcactacacttgacttgagttttagacttagtaaatctgaggtaaatgcagattgagaatgagaacaaaatgttaaaaagagaagcagtctcattttcttactactaataggcattgcagtttgtgtgggctctagcagggatgtttgtaccactgggatctaagcatctatttctatattataaatagaaaaattaggttgagctatcgcgactccattacaaacttatggaattagattctctggtatggagcttggatatacatattaaaacaaaataaaacaaaaactcctacccaattgattctgctgtgtgctctagttaagactgttatggttaagaaaataaataatcgctgtatggaatgtatatcgtcctattttaaattaataaaaaaaattttgcaggccttcccaccttccaactcctagagacaacaaatccagatttgaaaatcagtcatattaaatagttgtatcgatatttaccctttgtttctacgttattattttcttcaattttcacacgtatttgttcatcagttggttatgatggacttcactttttttcagtcttacgaatgagatttctccctccaaaaatcaataggcacctgctgattttatttattccaacatgaagttgcagaaaatgaatatggccaaaaatggttaaaaaaaaaaaagcctgttcttcaaaagactagatcgtcagttgaagcagaaaattatattcagtgcactggatttatgcattgttttagccttctccaaccaatttagaaatgcattttcttataaaattgagattattacaaatcctgtgctaagcagctgaaataatgtgcctatgccaaggtcatatcttaaaagtttggaggagcacactgcaattgaatataagtttataaatgtattccacatacttttctgatatattttaataatttaatttttacattttacctatattgtcttcattttcactttacctttggtggtgtttcatacatattcattgtttggaagaaattaagcagacagtattctaaagtcaatactgagtctgctaatgaaaatggttaagttaattaactaaatggcaaccttcactgaacttattcaaagctatttcccctcatgatgtgttttcctgaagaaatgatgcataaaaactaaacccctgttattcgctattcttctgtatcagcctctaaattgtcactttacatgttacaacctgttgcatgatgattaattatgacaatttaatggcatgtaaagggtaaaaccctaaaggattactcaaaccatcattccttaagaaaagaaattgtaatgcctaggttatcttctagggtttttatggttttaggtctaacgtttaagtctttaatccatcttgaattgatttttgtataaggtgtaaggaagggatccagtttcagctttctacgtatggctagccaattttcccagcaccgtttattaaatagggaatcctttccccattgcttgtttttctcaggtttgtcaaagatcagatagttgtagatatgcggcgttacttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaaggcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacatcccttgtaagttggattcctaggcattttattctcttgaggcattaccattcaggacataggcatgggcaaggacttcatgtctaaaacaccaaaaccaatggcaacaaaagccaaaattgacaaatgggatctaattaaactaaggagcttctgcacagcaaaagaaactaccatcagagtgaacaggcaacctacaaaatgggagaaaattttcgcaacctactcatctgataaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggactataaatcatgctgctataaagacacatgcacacgtatgtttattgcggcgctattcacaatagcaaagacttggaaccaacccaaatgtccaacaatgatagactggattaagaaaatgtggcacatatacaccatgcaatactatgcagccataaaaaaggatgagttcatgtcctttgtaggcacatgggtgaaattggaaatcatcgttctcagtaaactgtcgcaagaacaaaaaaccaaacaccgcatgttctcactcataggtgggaattgaacaatgagaacacatggacacaggaaggggaacatcacactctggggactgttgtggggtgggggaaggggggagggatagcattgggagatatacccaatgctagatgacaagttagtgggtgcagcgcgccagcatggcacatgtatacatatgtaactaacctgcacaatgtgcacatgtaccctaaaacttaaagtacaataataaaagaaaaaaaaaagaaaaaagcaaagaaattgtaaaatgttgttctatcagaaactcggctaattatttttaaattttagatcaaaaactcaactagttttaatgtactacttataagtcagataaaatcattttttatttttgttttctttttgtttttacatctgttagaaacgatggggtcttcaaagtaaaagaagagatttgcaatgcctataccaaattagttattttaggatactgaatgaaatggttttctatactcaataaaggtaaaagaataagcagaggtagatctggttttctgaaacttgaagcacattctaatttggcagttttctttaagtcaaagaatataacaggacaaatataaaattaggtatgaacatgattatagaaagaaaggaaatcataacaaattatacgtttttaaaaagatgacagataaccacatacatcacaaaaattgaaaaaaataagcagaatgttttcttaataatgaaccatctctgcaatactagaatatacagtgtctgaaataattttttctatctttctggatgcatcctctttcagcacctcttcatgtgagagcatcagaaaataatttactctttcccccagcattgttgattaaaatttgacttctatcattgatagtttagaaaagtttattttacattttcaacttattattggtgatgtcacataaattattacaatttattgtccaatttaggaagaccctgccaagtttctttcacatatgaactgtaaaatttaaaagatcattcaagttatcttgtacaataactaatacatatttttcttttagtcatactaaaccctgatgctaaggatcacccaaactttttcagggaaagaagtagcttgcaaataaatcaaggaccatttatccttactttttggaagaaatggaaaaggataaagtgttagtttaaatacactcaagaacagaatgtaagacaagaaattggaagcagagaagttcatcctcaaatgtaagagtgaaagaatagggttaatgaaacaggaaaggggaaatccaagaaaaattatgccgcgctttagagaatctcctaagcacagagatattggcaatgtgcagatgaaatagctgtcacaggtcagccatgtcagaggtgattccagccactaagtatctactgcagattagatatttggaaagcagaatgagctctgttcatgccattactggggcttgacttcttaatggtttcaagtccccctttgactctaatccttctaaagtcaactttgtataaactcttttcaaaagtgtttatccctgtagaataagttcaaaactccatgtcatggcacacaaaactcttcaaatcatattcagctggtattgttttcttccacattccagtcataactaggatcccaagaattagcaaataaaaatatgaaacatccagaattctaagcataactatgtcccaaatactacaacaaaaaatactgaaaagtatcgattgcttatacaaaatgtaaatggtatcctgtattttataaggcaaccctagtcataagatctctttcttcttcctcacacactgtcaagcttgagccaacagagtaccttttaatgggctgcgcagaatagctttcgatagtttacccattaattaacagaaaattcaaatgagatatcctctgtgaaatcatccttctctcctgcctcctgtctctccattctttctccaggagacagaggccctccagactccatgactttgtagtgtattgtgtctgtctttattagagtattcatcacttggtaattgaattctgtgtttaaatacattttttttcttccagaataagtgttcatagaagggagggatgatttacctagcatactgcctggcatataaaaggccctaaataatttttcttttaaccagtaaccaactaaccaattcaacagttttttaaatgagtgaaaccactttttaaatttttttttaaattcatgcttcacctgtaaaaatatatagatgaattgcaatctggaactctgagtaatttatataaaagtgatgaaaaagaccatggcttcagatttgttgttttaattccagcttcagttcatacaaacattacaaagtcgcagtatctactgtgtaaaaagtttcatcccaatgaagaaattaaaatgtctgtctaatagagatgctctaatggacagcgatgtgtagacttcagaagaatctcctcacacagccttggaggcataagttgggaacagagcaagttctgtgtttgcctttcaaaggaatgttcctttccctttcattgacaaatattataaagatgccccaaaacttctgtgagtttcccccgggacgtaaggtcctctgcattttcctaacttgtttctcaaagcggtggttcccaaggcctgagaatagctgtgtctcagctctctcctggaaaccagagcctaaaatgttgccacatcatcgggaatgtagctgcatacttagccagagccaagagatgagccccactcgcaaagcccatgggctggacaaaattgttagccatttggtgtaggtcattgcactaggtccattacacaggttatctggcaggagtcccggctttggaggaaagacgtttaaatcctgtaaataaatggctggaacaccatggcagttgattgtgttaagccctcatccaaaattgctttgttaggttctattctattgctcattatcttgctgtgaagaaaattaagcttacatctgcttagggtgacagggtatcctgttgtcacaggattttccacattttaggcctatgtcacaagctcccaataaaccctcagagaagatcttttgtgttcacaggcatccaggtgtcaggcagacacagtctttgtcttcttgaagctcagtgacacgttcagggctgtgtatactcctccattccctgccagagacaaaatgtttgtggaacagtcaagctagaagggacctcagaattaatctgatcaaatgtctgcatttttcagttccaaggatactcagggaaggccctcggattctataagtagcggtagaggtggtattagaagtcaggttgcctgacttccaaacctctgttagttactgtcccttcccctgcatgcagcactagtgtaatccctcaactctcacttccctttttcgccacatgcctctctctctttccttcccttgattaccctgcctatccctcctacaagggaaactaccaccaggcatcctcatctgagacccgggaatggaggccaggtcttttccctccctccctccctttcccctttttttgtgtgacagtaacattattcaagtacagctcttccttttttcagtaccttccccctcagaccagaagttaatgaaaaatagggttgcgtgatatgcagcctgggggccaaaaatgtaggacaagcagtgtgcttcagacaaaactgtagggttctggtttcatgcacaaccttggaggacggtggctagaggccctagtatgagagatcaattaaacatggaggccagaaattaaccacatgggattaacatacgtaaggttgcttcttttcaatgagtctaggaaacacactggggacaccttgttcaagacaagctactatttgatgctccttcatacgcttgcttaaaatatttgttcagcatttatttagtgggggcaagaaaaattgatgttatgttaataagaaaacctctttacctcttaccttttattaaaataatcaacttagaagatatactaaaactcacatgacttttgacatctatggatgatctttcatttaatatttttctgctattcctactatagaataaaagctgctattgcattattacagagcgtaatgtgagccacatatgttattttaatcttaatggccacattaaaatagtaaaaataaacaggtgaaatttatttggattatatgttttatttaacccagtgtatctaaaattgtatcattttgacgttgcaatcagtgcaaaaatacagtcatgctatgtgtaatgaggttttggtccatgataaactatatatacactggtgatctaataggattataatacagtaggtttaccatacctttttctatgtttaggtatgtttagatgcacgagtacttgccactatgttagaatttcctgtagtattcagtacagtcacgtgctgcacaaatttgcagcccaggagcattaggctatatcatgtagcctaggtgtgtagtaggctatatgtaccacctaggtttgtgtaggtacacactatgatgtttgcataaggataaaatcacctaatgacacatctctcagaatgtattcctgtcattaagtgatgcatggatgaattaaaatattttggattctttttttttttcagtactatgccttcggaatccaatatgtattttacagcatatgtctattccaaataggcatattctgggctgggtgctcaatagctacatgtggttagtggctaccatattaaccggtgaagttctatgcccatcaaggctacacgtaatttacagggtataatagtattttaaaaattaatttttttctggcttttatgttgacatatcgtttccattttttaaatttttgttttattttctttcactgctttggaaacgcacaacttcttggaatgcaaattaaaagatatcaaataatgatgtagataatttgttattgctaaatgtctaccacttgaaatattcaagtttcaaatttcagctaactgcgattgcaagcttcagctagctggtcccagatggatggcccagctaaatcagacatttgtacatactggctacaaagtgtcccaaaaacagaccaggagggtcgtggatttaaaaaaatttccaccaaaggatgctgtcttgtccattttccaatttgggtaaattaatggatactgcatttaaaagtttttttatttctcgtacattgaagccctgtactgcactcaccaactcacccgttaaagcggctctgaaatacaggcaggaccaagacttagatggactggaggttgggccacaactccttgaacacctagagcagaggtcagcaaactttctataacggtccagatggtaaatgttttaggctttgcaggccaataggtctctgccacgactacttaacaccgctattgtggatcaaaagcagccctaatacgtaactacacataaacgaatgggcatggctgtgtcccgtgacaatttacttggggacacaaatttgaatttcatataatattcatgtctcacccatttattaattattttcagtttcttcaaatgttaaaacaattgttagttctcaaactgtacaaagacatatggtggctgaatgtgacccataagccatagtttgctgccctctgcccaagtctcctgttgaaatggggttatggcaacaatcctcgcagaatataaaactattttggcacctgacttttgccctgatttttttattgtttccagagaaatcaagtatttttctttttcaaatttatatccatattctctttttttctttgctctcttctcttctggccagcaggaagagaccaacccatctttgaattgtattcactttcctcataccgtcacacagctagtaaagctacaacttcacatatgccaatgccaactcttcccgatgttgtgttcaaaacctttctaagcatcaccattcccaggagtagcaattctatatgatattattattttacttgttggtaaggttaaaagttccagggatactgattttcttctttgttagccatgtttcattgagtggataagcaatatgcatttgcttcatagtataaataacaataatgcatcaaattgcaacaatatgaatattacacatagaaaagataaatgtgagttatgtaggtcatgccatttgatagaaaattttttttatatttatatgtttaaacatgacaataaaatgattccattcagatgaaggcaaaggaataggatttcttttcagtgtggtggttttctatttttgttttgttttgttttgttttttagagaatgagttttggagaaaaacaagctttctagacagaaaatattgaaattaaaaccagcaattcatggtcatattattgaaactatcaaattggtatatatatttgaacactactgattattttctaaaatgttacgctttcaaaaaatcatgaagattggcaagttttttagatgcataagcaaatagtgtagtacggcttgtaacactgttcaagataacttttttataatgagtatggtctttctctgccctgtctaatacaatgtgggttttgagcattggaaatgtggtaagtgcaactaaggaactgatatttaaattgtatttaagtttaatacatttaaatttaaagttacattttgataaattgctttgtttttcttttttctttctttctttcttcttctttttttttttgttttgttttttttgaaacaacaatctcactatgttgcctcccaggctggtatccaactcctgggctcaagcagtcctccttcctcggcctcccaaagtgctaggattataggcaggcaccaccatccccagctaaattgtttcttaaatgaaacttctgaatttgaggatacgtgattatgtggtgtagttttccctttctttccccccctgaaatccatattctgaagtacagtgatttatataaaagtaaaaagaaggagactgttttttttttttaaattctattaagaaaccaaattttaacagacacctcagggcctaaataaatatcaagttattgttatttgttatggttcttgttgcttgggtaaaactgtacagatcatgacttagttttccttgaatttttatcaaacaaatgaacaaaatgagcaaacaaaaatattaaaaatgatatttcctacgaatccaagggacatttttctgtatcagccaggctgatgctaaggtccttcaagcaaataagatcaaagatttctgattggagagtgtgggaataaagtagcccttgtttagtgctactttgtagagcctttgtttagagtacggctgggagggagggagagagggagaaaaatacggggttaatttgtaacaacacattctgtggtgtgcgtgtgtgtgtgtgtgtgtgtgtgtgtgtgtgtgtgagagagagagagagagagagagagagacagagagagagattaaattacatttaacttctttaaattttattgtcctcagggtttaaacagtatgtgaccaaaatcacattatttagtgaagagtttgtgggtaggtggatagttagatgggtataaatccctataaaatccattttagaactattgaggtttgagcaaatcaatgtcacctattcacttcatttgtctaatgcctccaggagccattaaagggcttgttacctaactttagggtaggtttagatcaaggtgaacagtcagaaaatattatccatgtactcacgtatattattaagtattctttgaccatggagttagatgcttatactgcaaacaaataaattaatgaataacagtgctgctcatgaacaccaaagtttactgaaaagtcaatatggttttagtgtggtaataagggcagagttctccaaggactgccaacctatttattgtacatcaaattttactgactttgaaatcttgctagaaatgttcatttacctcgtaatgtattatatgtttgaggtcttgagaaaaataacaaaatccatgtgtggtaatgaagtggttatgcaataaaactaacatacactgtgatttgacacaggggacttcactgttatcagatacttaaaactggaaacaatgtaggaaatatagatgtataagcatcgtaagtaaaatccacatgctttaaaaaggaaatccacttacttttaaagtaatattccgagagctatgccactgggggctgaatgtcataaaaatgatttgtaattagtcacttttacattgtatatggatttatagttttaaaatatctggtggcatataaccacaatgtatttttcagtcatatattcatcattattttattaaatttccagagggaaagaaaataaatgacctcctagtgagggatattttaccacgagaccagttgtaaaaataatcgagttttgtgcctgggaagatatctttgctaagtctagttctccagtgacattaatttattgttgttaagaaatgtgtgaggcaaaatgaactctccaaatatttcatactacgtgcattttatccaaaagaagataatggtttacatgaattatttaattggtattactaatttgggggaggtgatttttggttgggggcaacagaatatttgcctaaaatgcattcagagtgcgctgttatttagctattttcaaggtagagggatattggcattggagacttacacgtagccatacaatggccaacttcagtcaactacagaagcaatacagggcagcggctggaacaaaatagctactaggtaaatattgattgaattaattacacggatattaccactagtcctgcaattaattaatacctagccctgtctccagccccagaatccatgacatcaagctaactaacagaaaacatatcaagaattttattccttagtcctcttgactgaccctcaagagggtctaccctcttctactctgtattcctcacatcaaatttcactagtccagccgccaagtaacacctgttctgactgtgctagtgaacttggatattcacacatagcctaaaatgggaaacagagttggaaatgtcatgtataaggacataagcgttttcaaagtgtacaagaacataagcgtttttaggagatttaccttctcttttctgttttattagcgaatgattgattgttttgtatgattgttcatttaacaaatgctatatcatgtaagaaaagttactaacggtatataaagatgtaaaattcaattgtggctgtgtgtatgtgtgagtattctagcttttggggagagacaagagaagaaagaagacataagttggaagagaacagtaaaataaagaaaaaagtaataactgacggtgtctaatgaagtagcccaggtaattaatgctagagtttattagatagaatcattatttccttccagagggattaagcaatcttctctgaggaggtggaacttttattacccaaaacatgaaggattgggaagagttttatatgtgtcgataaggaaaagagatattttattgagggaaaagaagacattttaatggcagagtacacaatgtcagaggaacagaccaaaagaagtgctttgttattaggaagatttgaagaatggaagatagcgtcagattgttaagaaccattttttagataaaggcaggctaaagaagttggaggctattggaaatcagtcacacaattttaagcaagagaatcaatgagtggcagttttgaaaactgaatttgatagtggcaaggaaaatagggctctatcatcccacttactttcaaagttatgaagaaattgtagtaagctccagtcagtacctaaaggaatttattttgtgaaattgtgtaaacaaaaagcaaaccttcttttgcactcatatagtatattttctcaaagtcatatagctaaagggaatgagaggtaaaatagtacagtggttaacaggataggcttcaaagcctaacttcttgggttcaaatcctagcttggttaccatttcacagctatctgaccttgtacaagtcacatgcgtacactgggaacaataatactacctgtattatagagttgttattagatgttgttgatagatatgttgggcacattttaggcactacatacataaacctctttctatagaagtatacatgtgtacctatatttaaaataatgattttcttttttaaaagaagcacatattcattgcagaaaatttttttgaaattttaaaagtaaaatctctggtctaagtgcactaaaatgttttagactttagatatgaactacaaaaacctacctcatcgacacccaaccccactcccagagatatttcattttatttgcttgctatcagtaatgagaagacccaattcaccacacaatttctgttgtatgagactattgtattgcagtgcaagatagtgttttaaatctttgttaaatcaataggtgcaatattacacctccctgtttgaattttcctagtgaagtcaaacaattttaataggcctatacataggtcagttatagttctttcctaaatggtctattcctcattatcctttttaattgagtatttgtctttttttctactgatttgtgagaatgtttttatcttaagagtgtcaaaaagatgaattgtttttgcctttttctttggcttgtttgattttttatgtaaagaaattttatactgctatgaatgtaagtcattactttatggcttttaaattaaaattataagaatagcctcccatattttcattacttttatagttcaatttttttacatgtaacatttcattcatctggtatttagttaggaattgtgtgagataggattttaaaattaagttaaaattcaatcaagtctttattttttaagtacagaagtttccgaattcagcatttacattaaattttttgaaaataatgctaaaatatcatgtaaattattacttattggaattgaaaattccctattattatttttaatctttataacaacttatgttatctatgcttctattataaaataaatgacaagccaaccaaaatagagaagatgcttatcacaattatatcatgataatttaaacatgattttggattaatcataatccaaaaatgcatttgataagcattctaactgttcttctagtccccataaaattaacaaatggcaaacagtaatgttttaattttcaaaatattcatattaatattcattttcaaaatatgtttacttgcatgcatttcatttatattatttcttattgaagttgacttctcaatgtatattgctttaatgatactaagtattaagggtatagattgtactcacacaaataactattgaaaagcataagtttaaatagatccatttatcaaatgatgtctttttttttcttttttttttttttttttttttttttgtgagacggagtctcgctctgtcgcccaggcaggagtgcagtggcgcgatctcggctcactgcaaactccacctcctaagttcacaccattctcctgcctcagcctccagagtagctgggactacaggtgcccaccaccatgcccggctaattttttgtatttttagtagagacggggtttcaccgtgttagccaggatggtctcgatctcctgaccttatgatccgcccgcctcggcctccccaaagtgctgggattacaggcgtgagccaccgcgcccggcccagatgatgtcaattttgaaagatactggaaagtatgttttgggagggaagagggaaggaaagagtagaatatgaagtcagtaaaacctggatatttagtgccatctttgttacttactagtaaccttatgaatattatttatattgttgatccttaatatcctcacttgataattttagaaaatgttatgtacttcataggatcatgggtagaataagaaagtgaatataagtaaaatccatcatgaagtacctgaaatatgttgtaaacctaagttataatagtaattttattgttgctaatatttcagaggaatagccaccaaaccagtactacttattatttatttctatttaacatataaaacatataatattctttctgagtggtaactttgaaaagggacaaaaatattaaaaattacattaaaatcatgtataatttataatactcctttcaaggttactaaagtgtgcatgtatttctaatcattcacaaatatgaaaatctatgtgtaaatttttaaattttctaaaaaattgacaaataaaaattgtattattgtcatggtgtacaatgtgatattgtgaaatatcacatattgtgaaataaacattgcggaatgactaaatcaagctatagaacatattcattaccttacatacttattattttttgtggtaagaacacttaaaatctacttttagtaatttccaagtatacgttattgttactaacagtagtcaccctgagttacaacagataactaggatttattcctcctgtcaaactgaaattgtgtatcttttcatcaatatctcccaaatcaccccacccccaggatctaataaccaccatttttctctgtttctctgagtttgacatttttagatttcacatataagtgaaatcatacagtatttgcctttctttgcctagcttatttcacttgacatcatgtcttccagttcaatccgtgttgttgcaaatgacaggatttctttctttcctaaggctgaatagagttccattgtgtttatataccgcaatttctttaaccgttcatttattgatggacatttaggttgattccatatcttggctattgcaaatagtgccgcagtaaacatgagagggcagatatctcttcaaaatactgatttcagttcttttggatatatgcccagagataagattgctaaatcatatggtagttctatttttaatgttttgtggatcttccatactgttttccacaataattatactaatttacattcccatcaacattgtacaagggttctcttttctccacattctggccaacacttttcttttgtctttttgataatagtcattctaacaggtataagatgatatcttattttggctttgatttgcatttccctgctgattagtgaggttgatcatttttttttttcatatgcttgttagccatttgtatgtttgctttagagaaatatctattcatgtcctttgctgtgtgtcgatactgatatgtaaaatatgcatacaaaatcaaaaccataatttatttttaatatatttttaatatgtcattaatatttttcagtgtaataggatgtttttcataatatttactttaatggacgcaacatatttcattatgtaaaagcagtttattctatttggggagatttcgtttcactttttcgccagagtgacataattgaacattcttgtcataggtctctgtgtttatctctgatattcccctaggaaaattcatagaagtagcattttggagttgaagggaatgagtaatcttaaggcttttaaagtagttttatcaaattttctaaactgaagtataaagacacatagaaaagtacacaaatcataagaatagaaattcagggatttttaaaaaaaacttagtgtatccatgctactaccaccaagttcaagaattagaacattacctcaggagcccctctcatgttccctcccagttatgagcctctcccctgccaccaccctctcccaaagataagcactcttttgacttctaacacctagattagttttgactttgaaattactataaacagaatcatccagtatatgcccttgtatttgacatgtcctgctcaacattatttttgtgatattattctatgctattgcctgtgccatagttagtttagtttttctatgtatggtattctattgtgtgaatatgccacagtttatccattctgctaatcaatggacattgggctgtgtctattatggggctattaggaaaaatgctggtgtgatgttcctgtcctttgctgcatatatgtatatatttatttttaatatacgtggaagtacaatggctaggtcataagatgtgtacatttggctttggaatcaccaaaaaacagtttttcagtgtggtcatttcagttcattttcaccagcagtatataagacttctagttgatccacatattcatcaagagtatgtattttcaacctttatccttttaaccatttaggtgaatgtgaaatggtatttcattgtgttttaatttgcaatcacctgacgattagtgccatttttatatcctcttatgtgaagtcattatgcaaatcttttgcccattaaaaataatagttgtctttttcttactgatgtagaagttatttggatacaagtcctttgtcagatctatgcattgcgaatatctttttccaacctaaactttgctttatttttttctcttaacaatctttcctgataaatggagtttgatttatcagtcttttcctttatggctaatgctttttatgtcttgtttaaaaaataatacattaacctaaaattgttgagatttttttctatattttcttttgaaaactttatttttttgccttttacattgaggtctgcaaacaatctagaatttatgttttgtgtatgatgtggagagtcaaggttcatgtttttcaaatgactaatcagttaacttggtgctatttactgaaaagatcatccttttccaacttaagtgacaccatcgtataaattaggaaacgctatatagatgatttgttctcacttcaatcccacacaggcttaattataataaatattcatgtctggtggcaaacattcttaaacttcgtcgttcttcaaagttgccttggatattcttagccctttgcacttacatataaatcttaggattggcatgtcaatttctactaagaaatggttgctgcaattttgattgagattgcattgaatttatagattatttgaagagagggcagatatctttacagtattggactttctaattcatgaagaaggtagtcctctatttgtttacattttcttcactgtctcagtagtgtttgtagtttccagggtagaagcttaacttttcggtctgaattaccaaattactagcaacatatatagtcatgcatttcttaacaaatgagatatgttctgaaaaatgtgtcattaggtgattttgttgttgtataatcatagagtgtacttacacaaagatagatggtatagcctactgcacatccaggctatatggtacagcatattgctcctaggctacaaacctgtactgcatgtgactttactgaatactgtagtcaattgtcacacaacaatatttgtgtatctagacacagaaaatgtaccgtaaaaatacagtatacaaatgataaaaaatagtacagctgcatacggtatttaccatgaatggagcttgcaggactcaaagttgctctgggtgagtcggtgagtgagtggtagtggtgagcaaatgtgaaatctaagacattattgtacggtaccatacagtttacaaacactgtatagttaggctgcactaaatttatgaggacacatttttatcttttttttttttttttgtatttttagtagagatggggtttcaccgtgttagccaggatggtcccgatctcctgaccttgtgatccacccgcctcggcctcccaaagtgctgggattacaggcgtgagccaccgcgcctggcccatttattttcattaatgataagttaaccttagcttatagtaacttttttactttataaactttttttttaagtttttgactctgtaataacacttagcttaaaacatgaacacgttgaacacccgtacaaaaatattttatatccttattgtagcagctttcttatttttaatatttttgctgtttaagcttttctgttaaaaagtaaaacacaaacacgcacatgagcctaggcctacatgggtcaggatcatcaatatcactgtcttccacttccacatgctgtcccccactggaaggtcttcatgggcaatgaaacattcatgaaactatcatctcataggataacaatgccttcttttgaactaattaagaatatagtaaatacataaaccaataacagttgtttattatcattatcaagtattgcatactgtacatacttgtctgtgctgtatttttatataactggcagtgcagtaggtttgcttacaccagcatcaccacaaacgtgagagtaattcattgcactgtgacatcactaggtaataggaatttttcagctccattgtaatctcataggatcacagtcagtctgttgactgaaatgtggtgaatgactgtataatagggctccaaggaagatcataaaattgcttgttttccagaactttgacaaagaccttttacagaaactaatataatagataaataatagtataacattgctgttttcctttgcatttcattgattactaactgtctggattttttcttgtttattggctgtttacatttttgtcaatttctttttatgttctttatccagttttccagtagatttttcctttttttactcattaaaagatttttttatatgctaaaattattaccctgtgtctgatatatgctgcaaatattcccagttgtcatttgttttaattttgattagtggctttaatttataagtgaatacgcatattatattcaatctttttatattctttttttgcttctaaaaggcttccccacgccaatattttattccagttcttcttactatttttatgcttaacactttaatttttctaaaatgttttgtgttatgaaatccatcttaatatgtttatttctaaaacagacacttttgcttatcttaatattaaaacatatacatttgaaattaacattcagagattgaaagaataaggaaagtaatcttgtgtgaaattaggtcaagatgtgcttagatactaaattaacacataagggaattgaatgtgtttgttttctttcaccacagggaacatgttatatgaagagcatggttttataatacataaaaggattattagaaaaatgatgtattttaccggtcaggtgtttgtgtctatactttgatgtgaatgcaaaatagtaaatataaatgtaaattaatttaaaacacatagaatctgatacaaaccttaatctttttccacgttatacattactcacacctgttatatttttccgtgaagtatttggaatactctcgattcctggaaactgttttaaagtgcagaagagcacaaaaaaaatatgtgttaaaagttcttgatttccacccaaccattaagtgatattgccaaagaaaactcttcagagcatttttcactgatggctttagatatgttataccagaataataatgattcattattaaaatatgcaaagtgtaatttctcaacaacattttgtggtaggaagatgagctggtacagtagttttccttattaaataattttttacaaaagtaattgacatggtttggctgtgtccccacccaaatctcaccttgaattatggtaatccccacatgtcaagggtggagccaggtgcagataattgaatcatggaagaggatcccccatactgttctcctgataatcagtaagtttcacaagatctgatagttttataaatgtgagttcccctgagcaagctctcttccctgctgccatgtagaatgtgtttttgcttctcctttgccttctgccatgattgtgaggcccccccccgccatgtagaatggtgagtccattaaacctctttcctttataaatcacccagtctcagatatgtctttgttaacagtgtgagagcagactaatacagtaatgcatttacattgttcaaaatataaaaggtacagtaaaaaatatctcaccctacccatcatctgctctaccctcactgcacattaaccttaattctagaaacaaatctacaaaataaattcctgggaataaaatttccaggtcaaagtttacatgctttttatagatatggccaaactgccttccacaagaggtacacaaatgtatacttcccaccagccacgtagaagagtctgcattttcccacagccttggcagcatagtgtacctgcagacttgaatttttgccagtgcaatagatgaagctctaattttcatttctctcattattaccaaggctaagcttctgttcatgcttttaaaatcctttgtattttcttttctgtgaactgtccttatcttttgtccaattttcttttgggttgttggcctttttcttattactttgcagaaggtctttcatgtgttaggaaaattagtcccttagacatgagtcacaagcatttatttttcataattgttcatttgtttttgattttgcctatggctcttttggtcgtgcagaagcttttgattttttatatagtccagtttactgatatttttgtctgttaattaaagttatttaacttgaggatacaatttacatttttttgtggttgactactatagacatatactgcttcttacattgaaaaaataataatcctgaatttggaaattgtttttaacaaacttttggtgaaggtccatcatatttaggaacagagcttgtttgacccagaaatcaaaggtcagtgagaaggagcaatgtaaatagaaagttaaatagcatgaggtaaatgttatgatggtgggaaagacaagatctgagaggataaacctaaagcaacatcataattaagctgaaaatttcgtctcatgataagctatcatttcattattccagatattagtcaaatctgacccattacactgttttctgtcaggaattgttttacctctattacaaggaagggatagtatgggaggatgataaggaaaccagcagtcttagttaaatgttatacagatttctgtgcttatatatgaagcctaaatgaaacgtgaacaatttcatgatcagataaaaaggagttcatcgctcagttttagagattttaggaaaatatgatggctattatctcagtagcttcagagtctagaggcatttagatgttgttagttgaagctgtaaaacgctttttacatctacttgtgagtagaaaatgatccaataaaaataaaatgtttagttacctcctttaaaatgcttgaaaaataagttgaggacatcattagatcatgtattacagacgtaggagtatatttgtaacatcacctacatcacacatacctgtgtgcgcgcgtgcgtgcacacacacacacacacacacacacacaagagttcagcaccacaggtgtagttatggatgtgaactcacaaaacacaaatcaagcaaagagaacaatatctcaattcatgattcatggacattctgtgctatctgaaacacaatgcttcttttgcccaactctcacccacacagggaaaggctgccaggaatgagaggcaagaagtgtgcaggtcaccttcaacaggagccaccacctgtatttcccatcagtcttttacaccattgtagtcacgtggatccaaggactgtattccaactgacagctcctgcgatgaggtgcagttccacacgacaaagccaggcccaacatttcccattcatcttaaagttagtgtttccaaggaaacagtgctgtgggagcctagggtcagtcccagactgacctgcaacagcccaggctggatgttaatcctttgcttatacagtctcatgaatttttcacaacatatatacatgcatttacaagacgtttcactgtacatattgtttacgtatacaatcttgtttaaaattcatttttctgtacattaattgatttttttctcgacaactttctctttttcatctcctaactcttgcatccaattaaacaatgtactgttcattagtgacttattttaaaagtatctaaaacaattgttccaaagcatgtgacattgtttatgtgacacactggtatattatctagtttatttttaaaatcttctctattattattcataatatattattatggaacagatgtatattataaaattttattcatattgcagtgtaatattttgtattacagtggtattgttaatagtctcgtaaagagctatcattacaagtttaaattctttattctgggatgccagttttaactcttgatattctgaagaaaatagctttactcttgtttattctggctctgtttttttgttttgttttgttttgttttttgttttttttgttttttttttgtagagatgggagtgttgctatgttgtccaggctggcctcgaactcctgggctcaagcaatcctcctgcctcagcctcccaaagtgctgggattacaggcaagagctacagtgctcagcctatcctggctctttatttacatgtaagcttgagcaataatcactgctacttaataactttattgtcattcattatcatgcagagtattgctctaaggtatgttcagggatgacgttactgagtcctaacagtaatcctatgaagcaggtgctatcattgtccccaatctacagaggaggcattgagagttagagaaaacttggctaaaatgttaggcaagaactagaaccagaattgaaatccaagtggcctaactctagacctcacaatgcttaataccatgtcatgctgcttcctaacctatttaatgtttttttcaaccccaacgtcatcacccatgtgtgatagtgggatcataataatatctatgtcgtagcattgttggatggattaaggaagtctacaaatgtgaaacttccaaggatgatggttggcatatactgatctcttaataaaaataacctataatcattctgttacagtctactctaatccaaatgttctttttacttctcatctcaaccacctgcttctgtttactaggactcacaaactatagctcacaaaaacgcataacttaccaattttccttgtacatgaagggacttccttttacaatcttccatgacataaaagaaagctagaagcaagtatagtagaagaaatgattgctatacaaacaaaattatagttggtttggttttaattttaggatgcgcattgaataaaaatcactcatttgggatttagaagacctgtgttatatatctggtgctaatgctgaataacttggcttattcatttttataactgcaaaggaagcgcgtatggcatataatacacaacacaccagtatatttagtaactgagtgaataaatgaaagatgtatttctttactttatcagttgcagttggctatgcctttgtgtaaggtgtgtgttttgaaattccaaaaaggtattagtttctttaaagcaaagaatttttgtagcaggttaatgaataattttgaatacattggttaaatcccaacatgtaatatatgtaaataatcaatattatgctgctaaaataacacaaatcagtaagattctgtaatatttcatgataaataacttttgaaaatatatttttaaacattttggcttatgccttgagaattatttacctttttaaaatgtattttcctttcaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggtagggaactttttgctttaaatatttttgtcttttttaagaaaaatggcaatatcactgaattttctcatttggtatcattattaaagacaaaatattacttgttaaagtgtggtaaggaagactttattcaggataaccacaataggcacagggaccactgcaatggagtattacaggaggttggatagagagagattgggctcaactctaaatacagcacagtggaagtaggaatttatagccaaggagcagtgtaggagtcagtagatggaaaattattaagaggaaacatcaggggtaagtgggattctggctaaaccaacctcacaggattcttgctgaagataggccagggttatcttatcagacaacccttggggaatggtggagaatactgagggtgatcaggtaccaaggataaagggttcttgtaaaactgacaggcttctttgctgaacctggattttacaggggagtgcaaagatgagcccaggcgaaggttcagaagcctgactaaagtttagtcaagcagggaatctttgtcatcatcatcattgttgtcataatgataataattattattattttactagaatatgttgctttttcctcagcatttactagaaataaggtcttcattaaacttatgttactagaatgcctgcatcatatttgttactgtgattcattttctatccctgttttaattgtgcttaatacatattcatagattccttatccaaaattgaagttgtttatgagattaggttcctaaaatataatgtctgggctcttttgtagacattgtaaagccctctcagactgactacactttacctttctatcttctcattctgccagcaatctccccgtatagtctggccacatcaaattacctggtacctttccatccatgtaatttcatgtcatacctgtgatcttggttttctctcttctttaaatgacttctttcagtttattttgatataatgaattttcttccattctttaagaatgaattcaaagtcattgcgtcttccaagttttcttccgtaccccaagtagagttagaatccctgttaggatttcttataaacctttttattcatctcccattgttcatatgttgatttacacttaaattttatacacctgagtatttcattacacatctgcactgttctttgagtgcagagggcattctcttatttatctctgcttctccactcatatcatacacactcagcctaggatccagtaaatgatgcttacttgtgagtgtttttaagtcaatgaataaagacagtaccaagacacccagaatacgaatgagatactgcaggtaagcgtaaggcttcagacaatcctgccaattgaacaccactatctccttcttctagtgtccttgtaaatgctgattgatcttcttttctccctttcaaggaatctattccaaagattctttcaatatgctgccccgttttgcgtctccttatttgccaaaatctttaagtagccaatcaaataaaccgaatcgttgaaattacaatctattaatgaatgtattgttgggcaacttcagagtaaaaaggataagtaacatttttgagtagttttttcttttatttaattgactttaattgttaaatttatttactgtccagtattgtaaaaacctaacattttaatctccatttagctgttgttttgctggaactgagagcaaagggaaaaggaagtttgagaatattctagtgaagaggaagtaaaagtttcgggaagatgggcatgagtaacaaggagatagagggaagtttgctacaactaaaatgagttagattagcaaaatgttctcgactatgtttaccttacttcctcctgacacttatgtctaccattctgatagctactcctcaagagcagatggcactgtggaagtcacaagtagacatcatttcactagcacaaaactcagcctgctcagccagtggcacagtcttgggttcagtctgatgattaaatttacgagacataataggctttacccagtaacaaatttagttagctttaagaaattatacaggatgggtaacaacagcctgcacattaaaggcacagtggaagtcttgataccaagacgtggcttctgatgtcccatcaccctgaattttagtcatacatgatcacaaggggcaagactgggtgcgtacaaaacacatcatcgtctcagggaagccatcagttctaggatcctgaccatttctccacttagctagtacatattgtactcagaggtgtttgactagctcctattcaccagtacaattacatctcatgaatactgatttttcactgctcaataaacaaccccaacaagaaagtacagttacttggcccaatacacaataaccttagccaaattctcaattatcttatatccagtatattcttaaaaagtaactggcgtaatattgcgaagaggaaaggtcataaagtctttcctcccaaccagaaatagctttttgtagctcacggtaaaagcacattctactcttttaaatgcaatctttggttaaaatgtgcctctttattataatagtttaaaaaatactcaatgctagctatctctcttcctggaacacatttaagaaaagatttttttttgaatcccttggtacaaatagatcctgtttactcaatcaaaatgacttttgtcccagtctgtgccccccggaatggttttcaaataatgaaaacctgcattgtgtcttcgattgtctatggcccatagggctctgccaaatgggtccctgcagtttgaagtgaaagccatactcggctgtgttaatcacttttctttatcaaagctacaagtcaccactcactgctgtgtgtagtttctgagagtcatgatatttgcctcctgcagcttgttttaaatcactgaggggagagggagctgcttttttcctggcagaaaactccttggcttcagtcctctgagcacattccgagtttcttatctctggagtgcagacttcaaaaatactcttttagcctttttcttctgcttgtggctgtgttcaaggtggggggaggggaaacataaaatcatagatttgatgacttgagagtttctcccaaaaattctcaaacccccagcttataattaggaaatggtgacctgtgtgaataataatttaccttgttttttatccctctttgtctagcttccattcctttcactaataaatgatttattaagattgcacagtttttctgatttaagatataggatattagtccttacagcctgctgtattcctctgcttaaaggaattaaactatttttccattaaagaaagatgggacactagactttgctttacttagtttcaaactactgaacaccaaaaataaaatttttaaggagttttgagcacatgcccttttttttaacacaaggtaaaaaaaaaaaaacacctttactaaaatcttaagaaagagttaatgcaaaggaagtagatatacgaacagccacgcccctagctccaaatcctaaatgtaaagaaacttgccttgtctggccatggtggccatagctgcctcggaaacaaagggtctgaggccttgccattcgggtagtttgttttctctagtcaaactctgagcacacctgttagaaaaatatgtaataccctctctctgtgagcctcagttttgtctgcttggtacttcactcttattgatgaaatgcagctagctgtgtagtgaaacccagataaaaaaaagctttaagggctgtgttctaatacattgtttatgctggagtgaaaattgactgcacattgcttggtttgtgcaatttactcccgaaatattcctattcaggaaatcctgcaaatagcaatattcatcttgaaaatcacctcacagaacccttagcaagctgagaaacataatcaatgagatcgtgatgtagagggtgaaaattaggcgtaatcacagccctttcccatcagtcagcccactagaaggcatgcctttgaattttgattttcaaatatactctcaatttagacataaaatatgttgatttcagatttcagaaatgataattgaatgctaagatcccgggaccagtttagaatttctataaagggtcttatgtttttaacctttaatgaatgctttcaataatgagctagaggtatactatttatctgacataagactgactactgctttccaaactttttattaaaatatgaggtgtggcgggacacataattttatgttaaggcttagtgactgaaatactttcatcttaatcacagggagggggttttttcctcccctcaagaatcactttccttctgtggtttataaataaacatgacatgtggctctgctggctcttccttgcagtataaggagcataattgcccataatgtcaaatccacactaaaaactaccaaaggactcaattgtagtgactgaccattaaagtcactgaacactgtgtgtgttcacattgctgtgagtgttgtcaaagaaaaatagcactagacaacagacaagaaagactgtgttcaaaacttttgcaatagaggagacagattgaactcaattctgctgaaataaaaggcaggagagcctctaagtgctgagatgagttagtgagaaagtactagatatcaggagggaggttagtcaatgtgcttatttaggccatctgtgtttgctgattggcacttatcaaagttagattcctatcctcccaacagaagactagcagattggggcactatcttttttgatgattctatatcaaagtgctagctcccaagtccttgagaaagtttattcctgaggtataaaagtggcaagaggctaggagaatatttttgtctcaaaaaagtagagaaataatatataaagttttctagagtaaatgctctaagaaaaggaaggtcaggtctaaagtcaggaagaaatctgtctcaaatgtagtcaaactcagggtatttttaaagctttctttgtcaaccctccattttgttcaagggaaaccagttttcccattgaaaaacttaggaacgccagttcatctagttcatttcagcaggtttctgttgttgaaggactagctgaacgaactctgacacttggtagtaatcagacatttcatgaaggagatttccatgaaagttagaaggaagacgaagattaatggttgaagcagactgcaaactcagtttttgagtccagagggcagcaagtcaaaaagattcctagaagctgggctgtaggcattctcagatggtagagtgaggatggcagtagcaatccgatggatttcttggagcatggcacggaagaggttggagtttactgaactttttgcatggcctacaaagcagcagctccaggcatgaaagttgtctatacataatttgctgtggtggtgagtcctttgtagtttatagcaagtcatccagcttctgcttgcagggcttctttagatattgtggggaaatggcagctataagacaacctagagaagagagtccttatctcagtaataatatgggcagtcacgttttagttctcagtgtcaccaagtcaggatggtgggagaaaaatttgaaatgttaatttggagaatcgcagccagattgtaaaggaaataaactgaaaattggtaaggacggacaaaatgtgtaagacagcaggatccagatcaatttacaggtaggtaaaaaaaaaaaaaaaaaaatcatgtcgtttacaaagaaatgcaaaatagatcaaagacaatgaacaggactagaatctgataaccccaagggttactgaaactctatctctaccatcacccttttgatcagtgttaatcaaagtaagactttccttgtttataaaataagactggcctatttatttatataggggtagcaaaaatggtaatttaccaaataggctattttaagtgtgattagctggaagttttcatgaagaatcacaagctgaataagtttcagagatatactgtacagcatagtgcctatagttaacgatactgtactgtacaattagaaatttgctgagggcagagtttaagtgttcttaccacaaaatactactactctcttttaggagcagtggtacataaggtgagaggaaacttttggaggtaacgcataggtttatggcatagattgtggtattggttttgtatatatactttatctccaaactcatcaagttctatgcattaaatatgtacagctttctgtttgtcaatcatacctcaataaagtagtttaaaaaatatgaaacctcagatttgattttttaaaagtctccaaagtttaggaaggcaagtcaagaacttgacatcagattttacctgaagtaaaatacctatagattcagctgaagtgttctgttttccaggttcctaaaatacccttggtttcctgggtctcctaagaatagaccttccttactcagttgtaagattgggaattctgtaagccaggtaccgggacagttttcccaaaaggggcttatattagctccatatagtcaagagtagctccttaaaactggtcacatctgactctatgcacttaattctcaaatatgacattccagtcaaagccttggttatatatttttttcaattatgtcttgttacctaaatatatttattgagcctatgcaaataattatattgccatgaaaataagaatactcggtaagaatttctgaattttacagggatcaggcagggataaaaagattaatgtttcattctgtttacaaaagcatactctaaattctcatgagttatagataacttaagagaaaaaggaaaggcgtttcttgtatttagcaaacagaacattaaaacatgaggaatattttaaacaaaagccataatcaaatcttttatcagttcattcaggcccatgtagttaattcttgtcttgcttgatcttgagttagtagtttcatgaactcatcagcttcttcacagagtttcataaatcctgactttgtccaatggtataatctcgaagttatttaagcaatggcatcagaagtctgtgtcccagagtacctgtcgtagtacttcctatgggtctcaaagatggtcctgttttactgaagatgatgcattctgacctctaactgattgtaagagcactcagggaagcatcagcataaaccaaaaactatctgtgaacgacaaaagacttaaaatggccataattaaagatctgattcattcgacaagaaattttttttttccctggtgccatgccacattttaaaataacaactggagttaggactgatgacataatattattatcggataaagtagcaccaggatgtgtcatggacacctagagcacctagagcactaacaaagttctaaggatttattataatttttcaagtatttatactaataatagttgacccatacaactataacctagtcaaggttcagcatctcttcttgtcaaagctttttatgcaactcaacataccaaatgaacctagttatttttaacatccttcattttacaagggtgcaggaacaaatcctttgaaatttttcaaaccaatctgagattaaaaaaaattttatttaagaattgacctgggaaaagcaaaatatcaaaggttgtaaaatgacaaaaggtttgaatacttggctgaataggatcattgctcactatgaaagaatgcatggctacctatgtaaccaagatgacaataaaagatttcaaaaataaatgtagaaggccacatgacggtaaaagtttttagttctttccaaagagaaaacactactttctaaaaaaattcaaggacatacaaaatcaacacaggtacttattctgataagaaacaatatttgtttcctatacagattacccaaaatataaaaaaaaaaacaaattttgcaatctcttattaagagaagaccaatagaaaagatgaaaatgttaattagtttgaccgaaataattgttttgcaattttgtgtgtgcgtatatatatatatatatatcaaaatatgttgcatacttaagtatattcaattttatttcaaaagagcagaccaataatccaagaatattttatcattttttaacaaaaagaaactacaactcatttttgatcaatacactgttgatactaagggtcatttgtaagagtttacatacacataaatccattccgttttagccagcattggctattaacataagactctccttccacaaatcttctgccatttccaatgttcattcagattttgtcctataccttcctcttcctcattttcacagtcattttaatttaggacaaagttattctctttttccttaacaaaaacacatccaacataccttgtatattttgcatacaaagttgtttccctttacccctaatgtttctggaagttttatttacatatattgattatatttttaaccattagtaagtcttattttatagagaaaactaggaattagctaagtgtgaactgtttgtcatataccagtatttcatagccaactagcaaagcttatgaatacaagttaaattcacctactcaatatgagggctaaaagtttacatcaatatttgtggaggagccttttaagattttcttttgccctgatatgtaatttatggaggctgtgttctaaaatttgagtaaatgactgaggagatacctagtggccatctgggtatctccaaatcccatctgaacgtacacggtatccagtctgtttccaattagctttttcaacctcaggtggttgcttctggggtttgagttttccagagcccccagtagtggcagggagcataacgctttagagaccatagagagttgagagactggagtaggaagagaaaggtctgtcatggatggacaaagagatggagcaggtacgggtttgaagaggaatatgctgaaggatttaagggagctaaagggaagatcaaaagtagtcaaaggaagaaggaggaatggtggtgatgggaagggagaggtcttagatgagccagcttagggagtgcttatgttttcggaagaggccattgaagttcatctttagtaaaaatcaaactaacaagaagagaagcctagtttgtgccatagaggtgaagcatctaatcagcagtagtcttcagaggaggagaaacagaatagtgagaatgtctcctggaggaaagaggcaccgaaggaacagcaacaacaaaaaaaggaaacatgaatgaggtctctacaaacgtgatctgtacagaaaatgatttctctaaatactgaaaatctgaagttgaaccaaatgagatttcaataagaattttccatgttctaaaccaatgatgcttttcaaacaaagaagcctgggactctagactcaagaatatactcagattactgagaatcaaaatctgatgttaccatgcttccacgctttcgtgggtaaggagtcagacttaccaatggattcccaattaatcagtcaggagtgtactcaacattcacaaaattagctttgcagaggttaatgtcattaaattcactttagaatggataattcaaattcaaatagtaactcccttagatagatgtgtactagctcaagttcacctgttatctgatttcatttttaaaaaaaattttttaaaagtggtgttcgggaggtaaggaacaaggaagagacctttagaaaaaagtttcagtgttttatattggatatgaaaatatcagtggaatgtgtcctgaaaaacactggatgacagttactggacaaaaagacaaattattcccttttaccatgcaactgaacacagatttattgaatgtttttctcctgagtttaggttgcctctgggcaagagtataattctggcttgataacaccttgaagcgtgtttgtttaagtttgtggatagtttcatctattagtggaattaggcatctgcttctctttatgaacactgggtaccataatcttcctcttactttttgttttttctactcaactccaaaaaccattgctgagttgaagtagaataataaggggaaagaaacaaaagactaagtttgaatcccagtgctgacacttactggctttacgatattgtttaactcacttaccctttttaacctgaccttcttcttcactaaaaatgaaaaattgagtgaatttccctgggactctgttagataaggcaaaactaagatgggaacacatttcctaaggcgtagaaaaagacagtgaatgggacctttcttgttgtatcaggagttatggtaagaggtactaacaataaaaattaggctttcagccaggcatggtagctcacgtctgtaaccctaggactttgggaggccaaagcaggtggattgcctgagcttgggagtttgagatcagcctgggcaatatagcaaaaccccatctctactaaaaatagaaaaaattagccaggcatggtggcacgcacctgtagtcccagctacctgggaggctgaggcatgagaattgcttgaacccaggaggcggaggttgcagtgagccaagatcacaccactgcactccggcatggggaatagagcaagacttctttaaaaaaaaaaaaaaaaaaaaaaaaggccttcaaaatacccctacagcagcaagttggtaccagaaaaacactccaaaaaagggagtagatggtcatgagattttcatcgttcaccaacctaacttgcccatataaggaaaaggataaacttgagaacagtttcttgaatgagaattcctggaacagatcattcaaataggactaacaatttgttggacatgagaaaacttctatgacttttactgttccctttcttatgagggaggggagaagagtgcttttcctctttgccaagccaaggaagagggcttcaaagaacctctattatagtggcattcagaccattgtatttataaaaaataaaaatattttagaaaattgaatatctgcttgcacattttaaagatgacatctattttctgcccttgggatacagtaaatattgacattttaaaagggtttatagtacagtttagaatgtatcccgtggaatccaaataccattgcaatataatgtctaccatcatatacttaaaaatacatgaaaaagctcatatttaataaatagaagttttatattattcctttttatttaaatcatatttttcaacttccccaatgaattgtattctaatgtgataaatatgtgatacatatttatgctataaagttttattagccactctatcataattctttataaaattatatttatgtggacttaaattcaatttttaaaaacaatttcctgtgactacaaggctctaagtatttttaaaattctctagattgagtagtatttaaagtattaataataaatacacttagtaataaccaaataacctaaatatatgtaccttttgataaataattattaaacatactcagtggatagttattgaaaatgaatctattatgagatggatgggtatttgatggtaccttgagtaaagaaggatttcagtcgctaatattttgaattgtacttttatttggcataaatgtatcttgactacaatgcaccagtgggataggtcagagaggtgtgcttttattttgtaaagcggaagaaagtctgtcattaaccaaaaagtgggcaagaaaattggaatgaagtgcctaccacaggaacaaatccagtcaaatcttttttttgtttgtttgtttgagacggagtcttgctcagtcgcccaggctggagtgcagtggcgtgatctcagctcactgcaagctccgcctcctgggttcacgccattctcctgcgtcatcctcccgagcagctgggactacaggcgcccgccaccacgcccggctaattttgtgtatttttagtagaggcggggtttcaccatgttagccaggatggtctcgatctcctgacctcatgatctgcccgcctcggcctcccagagtgctgggattacaggcgtgagccacctcacccggccgcaacatgctgttttaatgagcgcctgggtgcgggcagcctcaggcctaaaatggcgttagccccaagtgaggactggacaaaggttttatagtctcctgtaaacaggaagtctcctggcctgacgtaactgctgcattgtacccggatggcctctttctcgatcttcagaggtacttgtcttctggccggctctcttcctgcttctgctatttcgccggtgcatgctgctcaggcaagtagccttgtgccttaggaatgggcctgagaaaggaggagttactcatctccttaagctttcaggcccgggagagaatcttacaacccactgatgagttatgaaatccatttaatgggtaaaataaaatagaataagatagcatagggtaccaaagaatataacgcaggttattacattgtgttacgtgtggtatgcttaagtgttgttttctggaactgttgttatcatttgtattgtacttcatttttgtttcgaattttaagataatctgcacagttttatagaaaatgagttaattagtactgtatcagtgatgtcatactgggttaattattacaaagttgggggtaaatttatccctgtataacagactttaaagataatataaataggccaggcgcaatggctcacacctgtactcccagcactttgggaggctgaggcaggtggatcacgaggtcaggagttccagaccagcctggccaaggtgatgaaaccccgtctccactaaaaatacaaaaattagctgggcatggtggtgagtgcctctaatcccagctactcgggaggctgaggcaggagaatcccttgaacctggaggcggaggttgcagtgagccgagattgcaccactgcactctagcctgggtgacagagcaagactccatctttaataataataataataattttgtttatttattgaatagatactttcttccagtacaaaattcaaaagcattgaaatcctctgttgcattgttgtctttcagccacacagtttctctccccatgtgctgccaaggttttcagtttcctgggtagccttccaagaataggatgtaggtgtgtgtgtgtgtgtgtgtgtgtgtgtgtatattattttctactcttgtcctcttaaaataaagccagctgttagaatactataaatactgtttctgcatccttcaaaagatggttcttttgaagcccttttccttggcttggcgagggcagaaggaaaagcactcttcttcctccttcataagaaaggaaagactaaaatgcctgtgtgtgtgtgtgtgtgtgtgtgtgtgtgtgtgtatagcactcttctccctcccttataagaaagggaagagtaaaatgctgtgtgtgtgtgtgtatatatatacacacacacacacacacacacacacacaggtgattattttctgtattagtagttaaagaactgtctctttttttttttttttacagttgcatactattctgttctaaggatataccataattcacttaagcagcactccaattagtgagcctttagtttgtttcgacttttggctaagataagaaaatgtataactttgtgcacatcattttacacgttgcaaatatatctatgtgataaattcctagccgtcgaatggctgcgtcaaactggcatttgtcttgttagtacattttgccaaattgctcttcatagaacatctcgtcagtattaggaaaggtttcttttccccatacccgtgcccactcagtgtgttatcaacctttttgatcttctaaacaagaaaaatggtgatatctgtcattttaatttgaattctttattcattttgtgagtgaatttgaattttttcatgtgttgcagaatcatttttatttccttttctatgcactgtttgctacttttttgttttttgccaatgttctcttttgggttattggtctctttcttactaaggcaaatatagtttacaacttgaagtaaaaacatggttttctatgataaaggttttaatgaatgttttctacaacagacagattctagtcttaaggttataacctgaaaacatcaaaactaacctttgaattgcataggaatggtctttgctcttcttagccatcaatcctggacagaagttcaacatgatgacaaattgtagcacaagtagagatttaaaaaatttttaactaatatgtaaatatttgctttcattttcttatttatctaacaatacattgatggctagaacagggtttgtctttgcaaagagcctgtgtcaactgactcccattctttcaaaatacattacctaaagaaggtttgtggcttctctttgcattgcattttctagccaaatctgaaataactatctggaagcttaacattttattcccacacttatttttccttgtgaaaatcaaaactgcactttcccagtcttcatgagtaaccacaatggtttgccatttgacttgccagttgtattagcatactgagatgtaatttatctgcatcaagagagttaattctgagcagctgggggctttctaatctctttacccatcttggacaccagttccctctcactgctatttgttttattctttgcagttagaataccattcctcttgacatacaagaaacaaacccaatagaaattaaaaggttccaatttctattttccattcaccaatattataccattttctcctaaagcagttctactctctcctagatcattctcttgcttttgaaataaaccttaaaaagtcattttgtcaccctaaatatgtttatactttcttgaaataatgcttttactgcatattagaattttagtttttacttagcagtccttcactactcctttagaaggaaatttagataatactttgaaggaagttatgagagaacgtcagaagccatgctatcagttttttttttttatgtactctaaagaaaactctgctctgcccatgggtgtcatctctttctgattctgtgtggaggagaaaaatgggaacacttccaatcattttcaaacaatttctgcttaagtggatgaatggaccacctggtttactaactataatgcccaggggatggctttgattggcagacagaacgcggtgcagaaacaatggaagttaaatgaggaaggttttaaacttgcaagttacctcccttggtggcattgactgttggtagaaaataacacgttgggatttcagatacattcagacatgctctgcacttgcaatttgcaatacttaaaacaacacaattcttctaatcataactttttaaaaaatttggccacctttctccattgtctcataaagctatattcatgaagctgtttattcacaaagtcgtatcatttaaagataagtgttatatccataagtatgtaaatgaattaaaatctgggaggctaacacttatccattccttattctactatatcctatctagagccatgcttcttaaaatttaatgtgaaactgttatttctggtctgtggaaccacagtttgaaaagcactgtcatagattcttaagtagatacattttcatgcatacaataaatatgcaggagaagttaaatgggtatgtccgggagtcaaatattgattctcagaatgaaaacttcttcatttatttctcagtgatcttcataaccctttcccatactgggcagtgagaaaaaattatcatctcactctgaaatagtgatttcaccagtctctttttatgggttgggacctcatggataatgaccagtcttttagatttccttgctctcctcctgctcctctccaaaatggcagctgggttgacagatgaggaagcattatacatgacctgagatctctatgcaggtacttgcagtctcctctgaccctctgctctctggaacagtgcctcttgtctgcctgataagtctctaccctgctgaccttgtggctctgagcttgtattttcatcaggaaatacggttctctgctgactatatcagttactaaagggattcttaaatctctgagttactgctgaagaacacttagaattctaaatttgtaattatgatacctctaaaaacaagcgtgattatccattatgtataaggatgccttccaaaaagttggagcaacttgaagccacttgttacattgtcatttagtggaggagggagtgaacttggtgtttacaggtagaactctctatcaggtgctgtgaggaaaaacaaaagcaagataaactgtggccataatctttgttactttatttcccaatggggagaaaaagacaaatatatatatttgtcaaaactgaacagatgttatttgaacattatactgtatatgccattataactataatgtatataatacatatatataaattattgaacactaaaaagaacactttaagaattatctattttattttttttattatactttaagttttagcattaggagaagtatctattttaaataaagctatttcactcttcagtttccatctcaagaactcataccaatttaaacttccactcatatttgagagttgagaaaaattaccaaatgataataatatattatctaaaaaataatttaaagatgcatgtctctaacaaaactatgtaacattctgaagggttttaagtaatacttcatatatcctaattcagaataaacttagatgttatcagtatgaaaatatatcataaagtaacatgattctctccaatgaagatgtaatcatccaaactttatgcgttgaatttacggcttagaaatgccatagcaatatgtcctcttgaatatacaattctatatactgagatttcacttagtatattaagttctgtatcactgaagagtatattatgattctaattaacaaatacaattctattttatataagtacccctatcatctactaggcaaagttagctgatgttactatgcatttttttgtcagctgtactcaacttataataactttgtattccaaatacttcaaaattgccatatgcttactgttttcctattcacatcattttcccccctattcttcctgaccctcctttgagcaatagtgtcagtgggattagactcatgcattcacatactgaatgaatgaatcagtatgtgattcatgatatagaaaatttaaattccttatatatttcatatatcatatatatgatatatgtatctgtgcatataggggatattaaacacttctctgtatatatctgacatatattttgaaaaggaaacaccgtagggccaagttaactgcttcaattattacttagtgtaaatgcattcagtttgttctgtaatttcaaaatgatacatataaaaaagtagagtttgcatgtttaatacatctgaagctacagtttccaaattctgaacactttggtgacccccttgacacaatgaatatttggcagttaccgaacataacagggcacaaataatatagttaatgaaaacatccataattatttaaattaggctattttaagaaaagttttaatttgaacattaaacagcttaaaatcatttataataattgattatgtaacatgctggtcattaaaatgagattggtattctctttttttttttttttttttttttttttttccgaggtggagtcttgctccatcacccaggctggagtgcagtgctgcgatctcagctcactgcagcctccgcctcctgggttcaagggattctcctgcctcagactgccaagtagctaggattactggtgcccaccaccacacccggctaatttttgtatttttagtagagacagggtttcaccatgttgaccaggctggtctcaaactcctgacctcaagtgatccgtcagcctcagcatccgaaagtgctgggattacaggcgtgagccaccatgcctggccaagattggtattcttgacattaataattttggtaagcattaagaaggcaaaacatggaagcactcacaataatgtataggatccaagtaaaattctccttactgaaacatgaaactacaaagccatgtgcgcatacttttaatttttaagatttgtttgaaggaacttttgtgaatgacaagtagagaaagtgtggatagatagcatctctgtctttaaaattatttgatgaaataggtgataagaaacacaaaaattaataattcatgtgacctttattacaatacgtcttctggtattagcatagtaataagtattagtgatttacataattggagagataacacaaatacaaattatgcacacacacatacatacatacacgttcctgtgcttcactcaaaactgaacagatgttatttggacattgtactgtgtatgccattgtaactaaagtccaatttgttagagatagtattgttattttattatctttagtatcttcaatgagtccattatgaatagtagcattaactttgcttatgactagcttaaatagaactttggactccataaaaatacgaacaaagatttttaatggctttagaatacagaagtaatctggtaaaagtattcttgattttaatagaaaccaaacaatcaatgtgcccgttagattaacagtgaataatcagattgttccagctcttcactaatgaacaatgctgaaacaacattctctgtaggtctcctcagatagacatatgagaacacctagaagtggaattgttacctcattagagtattcacatttttaattttatcatatattgcaaattgcttttccaccagcagcaagaagtggcaggaatttattattttaatttgcatatccctggttgaacaagttttcaagtttgttggacagatttttccttctgtgagttgactcttcatatatttaccccaattttccgttggattgtttactttctcttaccgattaatatgagttgtctgtatattctagattctagtagagttctggattatatgcacctaatatataagtctacaattccttatccaaaatcttatcgttgacttttcaggagactagtgaaaatggctacttagtggaacatatggaaatcatgagttataagtgtataaaggctaagtgcaacagtctaaagacctggtatcacagatgaagactgacatattgagtaaaccaggaattggctttattacataatgtgtcctttttcttgatttcagaaacccatatatttgctgtttcctgtacatgtttaggaagagtattcagaagagagaatgcagatatattgttgctgtttttttttaaaaaaatacgagtttaattcaattacccatttgattgcttgagtttattagttatggtagcacttagaaagagttgttttagataatgactatgattttggtacagaacctaatagtaaaaacaaaacatctttaattttatttaaagtgcatgtcagtcatgaagtcagaattgaattgctcttttctttgcttttaatgaaaattagcctaatggctgttttatctttaaaaagcaacttctagtgtttaataataacagatttaagtaaatattctgttaagacttaaagaaccatgtccaattactatatggataataacttagagatgctctatattggtttaaaataatgcaaatatcactggccactattcagagatatgtcaaaatcacttttgtttaatatgtgcctttctagtccttagatctactgtattccctaatccttttggggtatataatccagagatattaggacccattcagccagaaactgaaacatgccatgatggttagaattcatcagaaccacactcaaatgaatgttaagagacatagcgtgataaaagtgcatctgaaagagtatatgaacagatgacattacatacaatgttgtatataagagaaaggaaggaaagacattcatatcatgtcatattaattcatgtacactgaaaatacagaccgtgaacagacattctttcatttgttccttcatgtattcaataatagaatgcttctctaccacagatgattccaggggaatttggcaattgctggagatatttgtggttgtcacacatgggggaggagaaagtgctactggcatcttgtgcatagtgaccaggcatgctgcaaaacaccctgcagtacacagggtagctcccgacaagaaataattatccagtcccaaatggcaatagggctgaagctgagaaaccctgattgaaactcacattacatcctaatcgaaactactttgttccgttctgagccgtaggattcatcaaataaaacctactttttattggtacaatatttaaatccagagaccctgtagcatagtaattatgtatgcaggatttgcctcagaaagactagggttcaaatctcagattcaccatatgttaggttgtgccctaggcaagtttctgacctttcgtgactctagttttttaatctgaaaaaatggtaatagtattgctgagaggctctgcaatggagattgagattaattaagatgatttatgttaagtgcatagcagagtgtttgcacttagtcagtttccaacaaatggtagcagtattacctttacatgtactaaatcatttcatcctgacctactatgaaaagcctgatcactttccatattttactgtttttaagataccattgattagagtatgcattgttattttatttttcaccaagaaaaatgtgctgccgttttagactatgacacgctatcatttataaaacgtgtcccaatttcagagcagctaacctgttgaaataaaatgtgagtcttataattgattattgtaaaacacaacagtaagtcttctttgattaggtgcaactgaacaatactatgaccacattcagtagcaaaggcacttagaaggatataggaatatagcttagcaggaaggtagcatcgggtatctctctttagtaggatgagtatgcgtagcaatctctgaagcacccagggagccatccaagagctattcactttgcagcacctgtccactctctcatgacatctcaggtgcacaggaaggaaacaaatcgagatgctgggtcaaccctggcctagaagccttatgcatcccagaggccaatgccttgtaacatagtttccaaggtcctcaaaaaggacatgcttagttacaagaattgttgtacttggggacgccccacaattatggttttccattaggtatttatagttcatatgtagaacacctaaccaaggtgtaatttaccagtccccatcatttttttttttaatctgaagcaatgttgcctgctcacacatttgacattccaactttatcagttttctagggagaagggagctagaaagttgatcaaagtacaaattctcatacagatggacaaagggtgtttttaaccctttactcacagtaatatctgttagtttcatttattttatatttaaagatactgaaacctgaaacttagagcagttaaatgacttgccccaactcatgggctaataagcctagaacccagatgttcttatttctagactgattatttccaacaacactgtaatatcctaaagcaagagtcagcaaactatggtccaagggccacatttagtcctccacctattttcagaaataaagagttattggaacacagccacatttatttgttcatgtattagacctgactactttcatgccacattggcagaatttgagtttggcccacaaagtctaaaatatttactatatggtgttttatagaaaatgtttgctaacctctgctctaaagtataattacaaattggccaggtgcagtggctcacacctgtaatcccagcactttgagaggccgaaatgggtggatcacttgaggccaggagttcgagacgagcctggccaacatggcaaaaccccgtctgtactaaaaacacaaaaattagccaggcttggtggtgcatgcctgtaatctcagctactctggaggctgaggcacaagaaccgcttgagctggggaggcagaggttgcagtgagccgagatcatgccactgcactccagcctgggcgacagagcgagactgtgtcaaaatagtaaataaataaacaaataaattctaattataaattgtttaactctttctatgagtctatataaggagtttatagaaaagcatttgtttctaatgtttgattattaaaaatacccctgtattttttattttattttaattgacaaataataagtacatatatttatgaggtacaatgtgatgttttgatatatgtttacattgtggaataattatgcatacttgaaggattttagagccacagagcctgaacctaaccgtttctctacatcagtgttggccaacttttttctttaaaaggccaaatagaaaaatttcagtcagtttttgaggcttcatgggccatttggtctctgttggaaatagtcaattcatgctaggattggaacctagataaccagactcaagagcccatactcttcaccagtaaggacttaggaaggcagcaagacctgggagtaccagtttaaatgaatgttcttctaagcagtgtcctgtgctgctattaaaccagaccagagctttggcccttagttaagaactgtatgtataaagttttccaaaataatggcttcaggttttcacaaagtccttccatccaaacaatgcagattgtacccccttaagaatctgttcttaactgccatctgttctctgcattcttaaagtctaatcttaatacagcagccagaatgatctgtttaaaaataagtcagatcacatcactcctctgctgaaaactctcctatgcttcctaatctcactcaggataacagccaagatccttccaaagatgcaggacctatcctcctccatccccaactctatgactatcattcctactactctccccttgctcactagattccactcaccctggtgtccttttttttttaattgaacatacacatacactcctgccccagggcctttgcacttgctgtctctgcacagattgttctttcctgagatagctacttgaatcgttccctcacttccttcagatctttatttaaataccacctactcagtgaggctttccctgcaggcactttctaaactctccacatgccacctccctttgccccatacctaagtctcttattcctatccagtgctttacattttgttctttagcacttttcactctccaaagcaccttaatttctcttttactacacattatcaccattagaatgtaagttttatgaggacacaaaaagtttgtctgttttattcgctgttacatatctagtacctcaaacaatgtttagcagacaataagtaatctgtcaatatttatggaatgactcaagtgattttttggaagagttttggtaatatttcatttgccaaaagaattctgccaaaaagactttgaaacccccactttaaggtggagagcttccatagaggcttctggatgttacttgatggtcacacctatgcccactctttcactggccttgaacatttcaagtatgcagcttagtagattatatcttcacagtttcacaacactttccagtttaaaaatcaatgctgcattatgctttgtatatttggacagattatttttgaaatccataaatctctaagttttttttttttaagtctccctttggtgagctgcccttgattagttcaaaatgggaagagagaacctgtcattctttgtcaatcaggttggcacgtacttgacagcatgcagttatagtgaaagagagctgtgttgcagtggtctagcaaacctaattgtagttaagtaaaagaacagtcacccaacatgagaggaaagacaaagaaactcaactgaacaatgttgtgtttttccatccatcagccttcatttgtcagagtctgactgacaatctggactgcagaaatcaggctctaacacaatattgattccatttcatattttgtttcttgctacactttttagcaaacagtttctgtatggaatgagagatagtgcagtcaatatatgcgaccagggcacatttatattaaaggcttactttggtttttttgtcccagaaatcacatattgtttgtttgttttactataatattgtaattgtcagctcttgctgcagtaacaaacaatgacaaaattccagtgacatataacaacaaacatttattactcactcatgtgtctgcagatcagctgcagctttactccacactatgaatcaagttaaggtcttttcattctagaatatggatctgctctaaatgtcttctcatcccaggaccctagcggaaagagcagcttttatatggcatattattctctcatgatggaagataagaacaaggggaaccagcaaatcttgaactgcctttaaagttccagctaagagctgccacacagtcccttctgtctgtccatggtctattggtcaaaggtacacagtcaagcccaaagtcaatgggaagggaagtatattcactgcagggcagccatattaagagaggaaatgaataataatgaactgacaaatcaaccatagtatccacaaatgtcttaggatttcattgattcccaaatgcattttttagtatttcaacacctctgaacttgagatatatcgtacaatagataatgtttacaaagtgtaggtttttttgttttttggctttcttagtttacataacaatagtggcccttatcatcaatgatagattagatagaaaaactgttaattgtggggttgacaaaatagccaaatggtagaaggcactccttataagtaagtaagttatgagtgggagctaagtgatgagaacacatggacacatacaggggaacaacacacaatggggcctatcagagggtggaggttgggcggagggagagaaccagaaaaaataactaatgggtactaggcttaatatctgggtgacaacataatctgtacaacaggccctcatgacacaagtttacctatgtaacaaacttgcacgtgtacttaaaataaaagttaaaaaaaattaagtgaatggacacttaatgtttacaaaaaagttgtcatttttatcttgaatttcttttttctgtagcaatatttatatctcattcagatcagcttatttgattagaaaaccaagcattaatagtagatcttatgtctatttattcacatattcatataccttcatttataaatatatattcatatatatttagaagatcaattggaaaacataagtgccattcccttatttaaaactcttgtagcttctccactacagttctgagggtggtatacaagatccttcttttctctggcttttgctttctatttctactccattacttcccattcccctacgtgatagctccgtacttcttctgcttcctgtctttgcatgttccatgttccctcttggaatacattctctctgccgtccatccccttataatgaggtgcatgagctgtttctgctcccagcctttctgtcctgaccttcttgtctatcaaacacaaaagtgatcagttcctgctctgtgctccattatacattgcactttactagttgttatacctgacctgctctaaatgtagtatatatttgtgtgtctgcactccccattcctaccccagtgaaacatagtaagcactgaataaatgtttgtcgaatgagcaaataaataaataaataaataaataaatgtttgaacatacatggaaaggttgtttatgtcctccttataatgtgctttgagatatatattcttaatatatatataatcatatattctaaggttattagtaggtaaaatgaaaatttaaagaaattgagtacaagaaaggaaaacaaggaagaattttttcctttttgtactatttctaagaacaccaaatttctagttaaacacacgcacacacaatcggcatgatgtagaattagaaatatgttgaataaatcaattattagaaaatgtaaatatatattaatttgcctctgacttgctacttttaccctcaagggttttttttttctacctcttttcatcactaatctttgcttcactgcttgtcagatcagcaactgcccattattagtaatgccatttaataagagataaataaaagtaaaggtgcttagagttactccatttcaaaaacctatcagggctggatttcagaagagaccatgaaattctcctactgttattgaaccattactccctattacctaattaatacaagttattttcttaaaattatacctgacattgtagtgaactatcaatactatgaagaaaatcaaactctcctcgtatcataaggatcttaacacctggtacacaatcttgcattggaggggacattaagaataaggcatggaggaaaaaaaaaccttaatggaaatgttctgttattagaaatgagactttttggtggaaatcccatgacgactttcttgtctgaatgttctttgaagttgaacactttctccttacacaagccggccactataattagctatgtttccattttagtggtggccttcttcaccttatctgaaatcatataaagatgtgaggccatttgcgagataaaaggtttgctcaaaccagttctctgacctggatatcagaggtttggcaatcataaacccactaagagaaaccctcagagctattacaaggctatgtaaaactttatttcattttttgtgagaagggacaggattttctctcatttatattctggaagaatattgtagaatgtatttgagttcaagaggaggagaaataattaacataatattaagaaacgtcaattttggaaagaaataataagcatatatgcacatgtgcgtgtatgcacacacacacacagtatacacaacagattcagaaagaaggaaatagagatttggtgacacatacttcctggatataatctcaactctgccatttgcaagccacatggtcttggataattgacctaatctctctcaattgcagcatctgtgaaattagataaaactttctttgtaggagtgtatgtgtgtatgaaaagcacagtgtttgacatataataaatgttttagcaactgtagcttgttaatattatcacagcagttaatatcactatagcagttagttgccattttcagcacagctaataattttagtagcattttctgatctttccatctcatgtggtttctttggagttgtttcttgctttgttttttagcttttctatgtcacattttatttgcatggagaaataacaaattttacaatttatttcacatattctttaatttttaggataattgtcagtttcttacagtttattttccttatactcactgaagaaaatatgtacgaaagaatattttcagtgaagttaattggatttactacagttgacccttcaagcaatagtatcttgcccttaataactgacctatctttgaactaataaattcaacctgcaaataaatgtagtgaggtaaattgtagaaatttatcttcaaaatggtctttctaaagtgatctatcaaaggtgcatttaattagaggtccagttctccaaaaatgtgccaaggaaaagtagccacaaagaatttagagctgaaatgaattctttcacccattgctctgtttctatagaactgagaataaatctcatatgggtacttaaaatctgtactatgtcattgaaggatgaaaagatgacaatagtgatgatagaaggacacggtaataggaaacatttcaatagagggaaatgatgtgagtatgcaatgttcattcaccagaggactaaatctagggctattttggtgacttgaacagggaatattctacttcctgcaagtgaaaaatatggacatttcatttggcatgccacctgctcttcagtccatcatgtagcaagcacccacttagtactttggagctctaagtaatacttggactactcaaatgccagccttgttgccatttctgtttattcgccaataacaattttattaattaaaatttgtatgtggatgtcttaaggaaattccttgtagttgtcaaagcagactcctgatcctatctatctgccagtgccttctgagtagtggtatctattcttcatgatttttggaactatttatgggtgattgaagaatatggagtggatagagaaggatgctagtcatttggctgcacacaagaaacacagatgaaatttttgactatttctgttcattttctaaaggtacagaattttcactggattgtacttgtaagcaattttaaaggaagaaatatccagccttttgaatttgttacagtgttgcaagacttttttaaaatgttaagaatttttatcatataggatgaattaatactctcataattttaggtttgtttcttccataattaataactatccttaaagattgtgtgtgtgtgtgtgtgtgtgtgtgtgtgtgtgtgtatttcttgattttccagagcaaacgttcccattcatttgttttactcaccttgttatagttgctcccattgtaagatatatctagtaagtttactgttgttacctaaatctgtttgctgaattttaaaaatgggaacatgtagtaaatttgggggaccacgagctagtatttacaaagtaaaccgagaacattggatataaaaccttatttcatttaacctccaatgaaggatatattcagtattattatttgtattatttcttgagcttccttgcttatctgtaatatgtaacatggtggcaccccttttcatataattctctcctcacttctattttgggtttttacatgttcttgtttcagtctcttctgctctttctatcttttcttggttcaactttcttctcttatcctgtggaggcgaatacctaattctggctctatcctcttcagtcactctacaagtatcactgggacaatattgtccaactactatttttacctccaaacctgtattcttagccttacccctaatctgcacactacgcttctttttgcaattactttctgtacatttgcatcagtgttaatcacaggcatcttgactcatgtctccaacctgaaaacattattccttccatatagggacaggctcctctgtcttccctgtacccctagacagtttctcccaagttataaaatcttggtgattctgaaaattttctttttccccatcaagtcctgccagtcctttatccacaacataggaataatacttcctgaacatccgtgctgctcctgtttgttcaataagtactcggacctctaaaggcatttcctatgtttcttccaccagccccttatccttaaaatcttgcctccaatctgccgctagagttatcatcttaaaagagtcaaatcagggttggtatccaagaaatattacaaagtactaagctcttggtatatacaatcaacttgagagaaagagagggacgggaggagagggagagagagagagagagagagagagagagagagagagagagagagagagactttattctgtcctctataacacctgaatgattctgtacatatttatgttaacagagcattgtactacttcaaatccttatacaagcaaaactcctcaccgccttttggcaatggaacttgcttttccctctgcctgaaatagtcttcagtatgttgacatgactcatttcttcacttcattccatttcctgaagagaggagcagtcttctgtgctcacattgcctaaaatagagcccactgtcactctctacttactctttttaatctttcttcatagcatacatatacatatatatacacacatatacatatatatacacacatatacatatatatatatatatgtatacacatatacaggcatacctctgagacactgaaggttcagttccagaccaccataataaagtgagtcacatgaactttttggtttcctggtacatatagaagtcaggtgtacactacactgtaatctattaagtatacaatagtgtatgcctaaaaactaatgtacatgccttaatttaaaaatatgttattgcagtgttcaagctgagagccaaatcaagaatgcaaactatttacaataaccacaaaaaataaaatatctaggaatacatctaaccaaagaagtgaaagatctctacagggctaactacaaaacactgctgaaagaaaccatagataacacaaacaaatggagaaacattccatgttaatggaaaggaagaatcaatatcattaaaatggacatactgcttaaagcaatctacagattcaatgctattcctatcaaactagcaatgtcatttttcacagaattataaaaaactatcctaaaattcatatgaatctaaaaaacagtctgaagagtaaaaacaatgctaagtgaaaagaataaagcatgatattaaccaacttcaaactatactataaggctacagttacccaaagagaatgggacttctacaaaaacagaaacttggaccagtagaacagaatagagaactcagaaataaagccgcatacctacagccatctgatctttaacaaagtaaacaaaaaaaaaaaaaatggggaaaggactccctactcaataaacggtgctgggatagctggctaaccgtatccagaggaatgaaactggactcctacctttcactatatacaaaaattaactcaagatggattaaagatttaaaaaaataaaatctcagccaggtgcggtggctcacgcctgtaatcccagcactttgggaggctgaagcaggtggatcacgaggtcaggagattgacaccatcctggccaacatggtgaaaccccgtctctactaaaaatacaaaaaaattagctgggcatgctggcgcatccctgtaatcccagctacttgggaggctgaggcaggagaaccgcttgagccagggagtcggaggttgcagtgagcccagattgcactgcgccactgcacttcagcctgacaacagagcgagactccgtccctaaataaatacaatacaatacaataaaatctcaaactagaagaatcgcagaagaaaacctaggaaatactattctggacatcagccttcagaaagaattcatgactaagtccttaaaagcaaatgtaacaaaaccaaaaattaacaagtgggatctaattaaactaaagagcttctacacagcaaaagaaactatcaacagagtaaacagacaacccacaagatgagagaaaatatacacaaactatccatcagacaaagatctaatatccataatctatagggaacttaacaagcaaaacgcagataaccccatgtaaaaagtgggcaaaagacatgaatatatagatacttctcaaaagaagacaaacgggtggctaacagatatgaaaaaatgctccacatcactcatcattagagaaatgcaaatcaaaaccacaatgagataccatctcacaccagtcagaatgcctattatcaaaaactcaaaacacaatagatgttggtgaggctgcagagaaaagggaacattatacgctgttggtgggagtgtacattagttcacccactgtggaaagcagtttggggatttctcaacttaaaatgcactgtcattcaacccagcaatcccattactgagtatatatccaaaagtaaataaatcattctaccaaaaagacacatgcacttgtatgttcactgcagcactattcacaatagaaaagccaaggaatcaacctagatgaccatcaatggtggactggatgaagaaaatgtggtacacatacaatatgaaatactacacaaccattaaaaagaatgaaattatgtcctttgtagcaacatgcatgcaactggaggccattatcgtaaatgaattagtaggaacagaaaaccaaataccactttgttctcacttataagtgggcctaaacattgggcactcatggacataaagatggcaacagtacatactggaaactagtaggggaagagataaggaaggggcaagagttgaaaaactaactattagatacggtgcgcactatctcagtgacaggatccatcatactccaaacctcagtatcacccaataaatatataaatgtaacaaacctgcacatgtaccccttaaatctaaaacaatagttgaaattatttaaaaaaatactttgttgctaaagcttgctagcagtcatctgagccttcaatgagtcttaatctttttgctgatggagggtcttgccttgacggagatagctgctgaccgatcagagtagtaactgttgaaaggttggagtgactatgccaatttcttagaataaaacaaccatgaggtttgctatgttggttgatttttttcacaaaagatttttatgtagtgtgtgatgttatttgataacattttacccacagtagatctttcaaaaatgaggtcaaggctctcataccctgctgctgctttaccaactaagtttacagaatattctaaaccctttgttgtcatttcaacattgtttacagcgtcttcaccaggagtagattctgtctcatgaaaacactttgttttgctcatctataagtagcaactcttcatccattgaagtttcattatgagatgacggccattcagttacaccttcaggctccactttattctagttctcttgcaattttctccacatccagtgacttcccctactaaagtcttggaccctcataggcattcatgagggttggaataaacttcttccaaacaccttgtaatgttgatatttacctctttctatgaatcacaaattttcttaatggcatctggaatggtgagtcctttccagaagattttcagtttacccagatccatcagaggaatcgctacctagggcagctatagccttacaaaatgtactttttaaagaataagacttgagagctgaaatgactcctttgtccaaggactgcagaatggatgttgtgttagcaggcataaaaacaaaatctcttggtacatcttcatcagacctcttggctgaccaggtgcattatcaacaagcagtaatatattgaaagagattttttcttctgtgcaataggtatggccagtgggcctaaaatattcagtaagtaaaccatgctgtaaagagatgtgctatcatccaggctttgttgttccctttatagagcataggcagagtctattagcataatcttaagggccctaggatttttggaatagtaaatgagcattgtcttcaattgaaagtcatcaattgcattagcccctcaaaagagagtcagcctgtcctttgaactttcgaagccaggcattgacttctctctagctatgaaagtcctagatggcatctttttccaatagaagactgcttcatctacactgaaaatctgttgtttagtgtagctaccttcatcatcttagatattagcttgatcttctggatagtttgctgcagcttctccatcagcacttgttgctccacctttcacttttatgttacggagagggcttcgtcctaaagcctcatgaacaaacctctgctggcttccaacttttcttctacaatttcctcacctctctcagcattcatacaactgaacagaattgggccttgctctggattaggctttggcttaggagaatgttgtggctgttttgatcttctgtccagaccactaagacattctccatattaacaataaggctgttctgctttgttatcatttgcatgttcactagactggcacttttaattttcttcaagaatttttcctttgcattcacaacttagctaacgggcacaagaggcctagcttccagcctctcttggctttcgacatgccttcctaaccaagcttaatcatttctagcttttgatttaaagtgagagacatgcaactcttgttttcccttgaacatttagaggccatagtacggttattaactggcataatttcaatattgttgtgtctcagaatagggaggcccaaggagaggaagagaggtagggggatgactggtcagtggagcgttcagaatacatacattaatggattaagtttgccatcctatatgggcactgtttgtggcaccctgaaactattaaaatagtaacatcaaagattactgattacccatcaccataacagttataaaaatattgaaaaagcttgaaatattgtgagaattatcaaattgtgacacagagacatgaagtaagcacatggtgttggaaatgttgctgatagacttgcttgatgcagggttgctacaaaccttcagtttgtaaaaaaaaaaaaaaaaaaaaagcagtatctgcagagccaataaggcaaaactcagtaaaatgaggtatacctgtacatatacatacatgtgtctatatatccactcacacatatgtgtatgtgtattatatgtgcatattatacatatatgttgatatgtgtatttatcatatctaatacacatatatgtatatacatgtatatcacacacatatattcatattgtaaattgaaaattttctagtgctgtatcccaatctctagcttataaatatattgaatagatgatgcagcaggtatcttttgaatacgcactccaattttagaaatataaatcttttttaaaggttggaataatataagtagtttggtgttcagtgcaaaaggttttaatgtataaatactatgaaaacaaaagttagatcaaatgtatcaaatacaaatgatctgtattgggggacagagggacacattaaatttaagggaatatgaggagaatattgacttcctatgctcgatgagtgaaaaagaaaagtgaagtgggagtgtttgaaaggaaagatgagcttttccatgctagtacatcacaggttttaatactcatagaagtttttagatttgtataggaaatatgatcctccagcctttccaagtttactcttctactggaattacaaatcaaaactaataaatgtttactatgcttcaagtgcaatagttataaagtacctgattagaggtcccacattcagatgttggttatataaaatattcatgctaaatcatataaatgctaaaacatttgtatttgtgatgttctcttggattgctagatggagattaaattatacaaattcagctaagaagaaaaatgtgggataaatggaattttagtttaaaggaagtcaatgaaaggattaattaagtataaaataatcccattttaatttgtcatagaaatgagttttctgagacattgttgtaatcaataacgtgaagatgtaaaattttgcaaaaaaaatcattacgggaaatccaaaagcagaagagtagactctgtatttaactctagcagattatttagaaagaaaatagtctatgccatgaacctttcgactgtctgcgtgaacaaatgtctctagtaatacacactcttaactcaattcccataggctcaaagttgcaacagtatttatttgcccgttcaacggttttttgtttagcacttactatgtgttaggcacttccagggatatgagtgaacaaggtagttatgggtcttactctcatagaggataattctttaggaatggtcaaaactatacatatacacataatgtgattaattgtgatgtgttttgaaggaggaagcaaaggagttggaacagtttaaataagactgtaggttggcagtgggaacaatggtctttgctatcatttttcaaaaattccaatgaatgggaatgacgactgttgcattaagttgcctgtctccctctgacccatagtgattctctattatcagagaggtagggcatgtttttcagcatatgtgataatatcaaacagattcagatggtgaaagtaaaatttcttaatgcttagaaataacataatttgatcaaatcatttggatatgttattaagttgttgtaagatatgaagacgtagctgttactactgccaatagtataaactttggattcagacctagctgtgtttgaatattaactctcccacatcccacgaggttgtgggcaagctattcacatcattgtcactaccgtcactactatcccacccacccttgcttcattttcttatctgtaaagtggcaatctgttggaatcagggttggggaaggcaaatagtagtcattatacgaatggtaactatgctatcatcaataatatagtctacagctatgatgaagctaatcagaaaacattgtctattaccagtaattagctatatcaataactatcacaagaaaagtcccagctgtcagtgaataaatagaaaatagtgctttgtcttagagaaacacatacaaaatgaatggtggtgacagtgctttaagttaacttgtcagtttatatgtgtaatgcatatataatttcaaatgtataatttagacattgtacatgtatatttggcctggtaatttatggtatacataaatgataaatgtataggttgaaaattcagttactttttttccttttcttaaatcatttttaccttgctgaagatatgctcttttctctacttccttagaataatatattttattttctcttaaagtattttgagaccatatcaccatttactacaccaaaatgtttttttgcaaatgcggtattcaagggtgaatttatagtggctggggacctatttggaattcagtaagtaaaactagattttccttattcctcatctgagatcagagctatttctacctctagcaaagacatacagtcattccgggtgctgcattttcagggaacaatgtgttttcttggcaaggggcagtaagaccatcaattaatagttcttcatgtaaagtagctaaactactgttataaaggaagtgaaatttgcatacataaccattaacacatgaggttagttatgtacaattttgaccaaagtgcctgtttgctgctggtatttattataataagaactggaaaaaaatagtctatctcaagagcatgtgctgagcacccgtaaattgcaagagactgtactgggcagtatgagattatagtaatttgggatttcctactaatgaactgagagggaacaggtacaaacacagtatacgaaggaaacagtggcacggagacacttaaacacagcagtgctgggaggctccggggtaggggagggaggaagagagatacgggttaatcaggagctgctctctggggaagattgcccaggccctgactgatgcctgacattgattaattgatactctatcctagtgtttaacaagtgttccatccaaaaagtcttctgtaatatttaacttcacttccttcagcttcaatttctgcacaattcttttgtcgtctcatcaagagagctagtcagcagacagtaacaaaatgcttatattcatatacctgaaggatttttttttgtcatgcttcagccttctccagactgaagaaaagcaaataataaacaaaattaatcgttcttcagaaggcctgtttgactcattaataaataataagctttgatactgtgctttaagtgtttaccctttggaaagaaaataattttgacagtgatgtagaaataattatttgatatttatttcaaaacaaaatttatatccaatactaaacacagaattttgtaaaacaataagtgtataaagtaaaatgaacattaggattattgagattattgtagctaaaactagtgtttattcatataaattatgttaataaattgtattgtcattattgcattttacttttttgaaaagtagttaatgcctgtgtttctatatgagtattatataattcaagaagatattggatgaattttttttaagtttaatgtgtttcacatctctgtttcttttctctgcaccaaaagctacatttttgtgcccttatgtaccaggcagaaattgatctgcaatacatgtggagtctccaagggtatatttaaatttagtaattttattgctaactgtgaagttaatctgcactatatgggttcttttccccaggaaactgaaatagcagttcaagctaaacaaccggatgtggaagagattttgtctaaagggcagcatttgtacaaggaaaaaccagccactcagccagtgaaggtaatgaagcaacctctagcaatatccattacctcataatgggttatgcttcccctgttgtacatttgccattgacgtggactatttataatcagtgaaataacttgtaaggaaatactggccatactgtaatagcagaggcaaagctgtctttttgatcagcatatcctatttatatattgtgatcttaaggctattaacgagtcattgctttaaaggactcatttctgtcctggtgtgctgccatcaatacaaaagtagtcccaccttcaaggtagattaaattctttggggctttattgctttgcttgccagccttgatgcttttcatattgtttggtttaattcaaatcaagctactgcatcatagtgtctgtctccaacagctgtaaagaatcacaatatggtccgtgacctttcttttctttgttgctctttcttataaaagagtaaaatcggcattgaggcttcagtattttattgggtcaagaatttttagtgaaatgtcatgtaattgcttatttctttggcaaaaagctggcctgggataaacctttctacttttttttcttctccatatccatgttgaagtctaggtcacatttattcacaggctattacataaggagggagatggaaagccaggtcagttttcaaaaaatagctaatcaatggcttccatttgcaaatgagagtccagtgctaaatatacgttagcagtaggttacctgattctctgtacctgaccagaattataatggctcccattatgatgaaggttcctgagatcctgtaatcatggctgtttattgatcagtcttggtttctcagttaatgttgcaggcttggatacaatgaacctcgtcctcatgtttaaaactgcttgaaaacagttcaggtcaataacctcattatacagaaccagtttgtccttgcaaacaacattaccatgacttagattctgtctctaaggtcgctgcttagtttcccttgcgcttggcccaagcttcatttctagaagattgtttgttttccttacagcttacaagagacttttccttaggtagagttgaagtttgcacctgagcttaatgtccaaacaccagacactgaaaatcacaggtttctctgtagatatcaacatacttttattcagaaatatattgcaaccactccaaaaatctagaaaagtagtttgtatccagttcaagcccagtataatcatttttcataagctaacaatgtgctcagtatttagttggaagagctaggcaaagtcctgaaagcagcaaatttcagagtttccgttgatgttctgaagaaagccagccctcagagcagttaatatggtgactttcattgtagcaagccatgcagtgcacaaatggacaattgcatacgtttctatctactctttgttgatcctcaaagactttatgccttatggtgtatgactatgaattaaggtttgtcactaattgttagagatcacaaaggtacatgtaatttggcttttacttttgtgcctttgtaaaagagagagagagagatcttaattaaaagccactgagaaaatttttgctttcattatgtataaaacaatccaaatgcttgatgctaacttatcgcacctccacccacacactcaactactgggccacttggagatcagaactgggatctgccatgcctgagcatatctgcttcctgctgatgcattagtgatgtaaaaggagaattacttttctgaaataaaaagaaagaaccaggagctgttgctttccttctctttcacaacccttaaaaccatttttgtagcagacagcactgtttttttccttcctttttttttttctccttccctgtttccctattttctctcaatttgacacattgggagaagctgaacttaagggaaaatttattcctgtcttcccatttctcccttggatttggagaaaaatcaacatatcaagttggctgggcatggtggctcatgcctataatcccagcactttgcgaggccgaggcaggcggatcacctgaggtcaggagttcgagacctgcctggccaacatggtgaaaccctgtctctactaaaaatatgaaaatgagccagctgtggtggcaggcgcctgtaatcccagctacttgggaggctgaggcaggagaatcacttgaacccgagaggcagaagttgcagtgagccgagatcgcgctgttgcactccagcctgggcgacacgagcgaaactccgtctcaaaatatatatatatcaagttgataggggcaaaaatgcaagaatgatttgagaattatggggtttaaaaaaatagttgactcacgcacaacttttgctgtggaccatgaccttggaaacatctgaagattagctggggtttgcggtagcctgaaacacctagaggctcaaaaaatgacctcacagttttgaacatgacacccagcaatacaaggcagaaagctgtgagggctgtttaaatctctgcatggatcaaaaatttatttttaaaggttagagatgatttttctgaaggacactccattgctctgatagaacgtgaacaaagcctttttaaactttgagtccatatatcaaaatttaaaatttgtcctatttataatgcctcttcttcactctgggtcttgttacctcttaatagaagaggaaatgagtctgagtagcctgcagcacattttcatgagagaattgtgtttctgtttttgttttttgggggaggtgcatttggaaactgtaataattatgaagaaaatgatattctttaaaaagaaaatgaaaatctctcacgatgtatatgcaagatctagtatttaaatgcataattagtgtgtccaccgcttacaaacattctaattaaagacacatcagggagcaattctgtttcttaggaaattgacttgtctattggcacctccgcattctgcatcagacagcctgtctgtccagctcctacgctcacctcccaagctgagttctgattggaagctgggttcatccctgctcagtttctttcctctttcttctttccttcacttcgtcaacttctttaagatttcttttattttcaaagatggtatatttctggtttcttttttaaaatctctgactaaccaacttctttattttctttgaggacttcctgtaaaaggtcaaatacatattatgaaatgataatactaatgacgtataggtagtactaatctctgctgcaaaataactggaaaaatcttaggatcgtatgatcaaatacctctccatctttgtttagcacttcaactctctttctctctctctgtctctctctctctctctctctctttccctccctccctctccactctctccctctctccctctctccctctctccctctctccctctctccctctctctctctctctctcccccttcctcccccatctacacacatacttttatttatttgtatgttatttcttcatcttaacttcagaaattactgaagactgactatatgagttatataaattgtttaaaattttgctaaagttatagttttggtataatatattacattaatgccatagatgaaatagtctttaatgtgttccatttttccacacagtaataactaggtcctcaatagcaccccatttagcagtttaaaagcagcaaaaacaactgctatcagtaacaacaatataaactacaaaagaagccatttgttatttgatttttattataaaattgtatttttaactgtcttgagcttaagcatttaggtgccattttcttgtattcatactcatttttaacttaagttggaaaactacactttcagttaacttttaaaaatatgtttatgtactttcaatgcttacatcacctgccatgtattagaactgagagcattaatggaattttaaatgtcttggttactttctaaagtgataaaatgaagccagctggtttgctttgctaactttttatattatcaaaaaatgttacttacacaaacctagtaatatgttttacttactgctcttgaattatttttcaatgtaacagaaaaaggtgtgaggaactttctgtatttggccaaagcgttccatcccaacctttaacacaaaataattgctgtagacaaatggtcaagagggcaattataatcttccaggcatcatttcctcagatatgaactgcaaaatgacagcatcattagtcattttcaattacagtcagtcacaaccagggatgattcattttcccagctgttttgttgttaattaactagatgaagctgtttttttttctcccaatgagtttgttctactgccaacatcaacatcttaacatttttaaaaacttccttagggtttattttttgcctaacaatctttaatatattactcacaaaagatgtgcatctcaagatttatccacggtatagcaggtcaaatggtatttcattggtcgaaatgttgccgaaataaatataattacacttaaaacaatacttggatttcataaatcatctgccatgcgtacaatctcatttacctggtgtaacttcacttgtagcaacagaaatcaatagagagataacagacaaaaattgtcccctgaaatgaacaagtctattttgactgactcatttattgagcacaatttccatgccaataacaccagaataagttgggagaggacttctagaaagaagataacaatattagaggcatttaataatttataagtaaatgcatagcaacattttatttttttaaattacaagtttgcgactgggcgcggtggctcgcgcctgtaataccagcactttgggaggccaaggtgggcggatcacaaagtcaggagatcgagaccatcctggctaacatggtgaaaccccatctctactaaaaatacaaaaacaaaattagccgggcttggtggcaggcatctgtagtcccagctactcgggaggctgaggcaggagaatggcatgaacccgggaggcagagcttgcagtgagctgagatcacgccactgcactccagcctgggtgacagagtgagactccatctcataaataaataaataaatacaagtttgctttacaactgaaaaaaaagtcttggagtataagaggttgaataaatgctaatcccaatgcataaacttgaggagagcttcactttcccaatgagaagagaaaaaatttataatagatttttgggcaacttgtaaacataaacatttagaaatatggatgagattgtcaaatgtctaattatattcaatttcttaattgagtagcatttccatatttgcagtcttacattttataaaataacacactcatttagaaatacctggcacatttatattttatgaaacaatttcattcaaacccttcgtatgtatattctagaattgtagagctcatcaccttgctaagttatttgtaatatggcattgtttgaatccctacataatactctgaaagccctctggccaagattacaagcaacatatctgtaatcaaaaaattaagaatatttaccttattgcagcaagagcgtaaaacacttcagagtgtgggcatctcagtaagagggcattggaaaaagcttcttacagagttcagctggctgcatgattctaaggaggaattcagaaagtagaagccatttctggattagatgctttcaagaaacagagtcaatgtagtgattaggtatcttagtgtttatctagaagatgagattaaagtagggctagacacgtcgttggtaaaggagcagcaatgcctcatattagtcatttctgtgatagcagaaaggccttgtctctgtcttgtttcaaacacggccatggggtggccttgtgtctgcctagtttatttctatgagtgttttttaacatccagctgggaccatcatggcctagctagctgccagctgccagctatcagcagagctatttttcacgttctcaatgctgtcgctgaaatttttatcccaaacttcaatacccattcacaaaatattaggaaaactgtttttttcatttttcttagatatgattttggttgtttgtttgtttttgagacggagtttcgctcttgttgcccaggctggagtgcggtggcgcgatctcggctcaccgcaacctacacctcccaggttcaagcgattctcctgcctcagccttccaagtagctgggattacaggcgcccaccaccatgcccagctaattttgtatttttagtagagatggggtttctccacgttggtcaagctggtctcgaactcccgacctcaggtgatcaggctgcctcggcctcccaaagtcctgggattacaggcgtgagccactgcacccagccagatgtgatcttttaaaaattcccaatagactaacatattctttctgctttttaagttgtttggctttttaacaaattctttgaaagactcgtttacaatgatctctgccacgagtgattgtgaagctatacattaggaatgattgctaaagatttatcaactttctttgcctccctttttaattaagcaaattctgtcagaatacttatgtaagcatcacatctcttgaggttatttcaggctaatatacaacattgtggttccgaataaaataattgagacataagagatagtataaagtcttgaatatgagccaactttcttttctgagagaatatttgagtgaaaagtctcatgtactcagtagctcatgctgaaattagggaagcattttagagatttgaatttcacctcttgtcctcagttgtattagttacacttaaagagagagacaaagagacatagatgtttcagttacaatattcgaatgtatgcctgtatatatacagccgtaggtagagtcctttatttattcagtagatattaattgcatgccaaccattgacacaagatatatttttaaattttgaaaatctcaaactcaaatagagtttaaaactatattctagtttacttttttaaacaaatgattttttatgattgtattaaacaaatacattatttttccttacttattctacatcaaataatatctatttctagaaggcttttttccttgtcttaatgatagaaaacataaaaatcatttaatattttttaaatatccaaaaaatatgaggcaagaaagcagccacaattgtagctaccttaggaaacttaattaaaaaatttttttttatttttaattttatatgtgtataattgtacatatttatttgtgcggtacaagttatattttgcttattttttataatttcagtagttttgggggtataggtggtttttggttacatggatgagttctatagtggcgaattctgaaattttttatgtatccatttcctgagtactatatactgtacccaataaatagtcttttatcccttacctcactcccaagctccccacttagagtccccaaagtccattgtatcactccgtatgtctttgtatcctcatagcttagctcccacttacgagtgagaacatatggtatttagttttccgttcctgagttactttacttggaatagtggctgccagctccattcaagttgctgcaaaagagattcttttttatggctgagtaatattccatggtatatagataccacattttctttatccattcattggtcgatggacacttgggttggttccatatcttgcaattgcaaattgtgctgctatttttgtgctgctgctttcttttttgttatttccttttctggttttggtattagggtgatactgacttcatagaatgatttagggaggattccctctttatcttttgaaatagtttcattataattggtaccaattcttctttgaatgtctggtagaattcagctgtgaatccatctggtcctggacttttttttggcaatttttaaattactgatattcaaccttgctgctcgttactggtatgttcagggtttctttcttttttttttttttttttgagatggagttttgctctttcacctaggctttagtgctgtggcatgatcttggctcactgcaacctccaccttccagtttcaagtaattctcctgcctcagcctcccaagtagctgagattacaggtgcccaccaccacgcccagctaatttttgtatttttagtagagtcggagtttcactgtgttggccaggcaggtctcgaactcctgacctagtgatccacctgcctcagcctcccaaagtgctaaaatcacagacgtgagccaccgcgcccagccaaagcgttcagggtttctatttcttcttgatttaaactaggagggttgtgtgtttccaggaatgtatccatttcctctagattttctagtttgtgtgcataaaggtgttcatagtagtagtgaatgatcttttgtatttttgtgatgtaggttgtagtgtttccagtttcatttctacttgagcttatttgaatcttctctcttctttccttggttaatcttgctaatggtctatcaattttgtttatcttttcaaagaactatttgtttcatttatattttgtatttttttgtttcaacttcatttagttctgctttgatctttgttatttcttttcttctgctggatttgagtttagtttgttcttgtttctctagttccttgaaatgtgacattaggttgtcaatttgtgctctttcagaatttttgatgtagtatttaacactatgaactttcctcttagcactgtttttgctgtatctcagaggttttgataaattgtgtcactattaatcatttcaaaaaatattttaatttccatctcaatttcattgttaaccccaaaatcattcaagagcagatttcttaatttccatgtgtttgtatagttttgagggttccttttggagttgatttttagttttattccactgtggtctgagaagatacttgatatgattttgattttcctaaatttattaagactttgtggtctcttgtatgacctgtcttggagaatggtccatctgctgataagaatgtatattctataattgttaggaagaatgttctgtaaatatctgttaagtccatttgttctagggtgtaatttaagtccattgtttctttgttaagtttttgtttcagtgacctgtctagtgctgtaaatggagtattgaagtcccccactattattgcattgctgtctatctcatttcttaggtctagtactattgttttataaagctaggagcaccagtgttaggtgcatataaattgagtactgtagtaaatatcttcttgttggactaatccttttatcattatacaatgtctttctttatcttttatttacggttattgctttaaagcccattttgtctgatataagaatagctactcctgcttgcttttggttcccatttgcatggagtatctttttccgtccttttaccacaagtgatattttgatacaagcatataatatataatgatcaaatcagagtgattgcagtatctatcaccttaaatatttatccattttaaattttaaaaggaaagctatattcagaaatcactttttcttgtaactaattcctgttcttcataaagcagaaatttcatagtttgatatagttgtcttaacatttaatgaatattttcaagcaaagtatatacaatggagaataatgctcagctgcaaaagtcacctataataaatctgatttttccatttacaaacaaaagaattcccaaagtttatccattttggtagaacacgaattcactctgttgagtttggagctcttgtgcggaaaaccttggacctgcaatttagttagcatattcaaagttttaaaattatggagatgtagtcaagaataggacttgataactattatcccactgatacgctatttaaataagttgggatttaagtacttatttgatttccttaaatttgcttatagatgattaacatgtattgcaaattgttaccttttacagatttctattgagcactgcttaaattttattatatgatgaacacctgactagttgctacagccaaacattttttgttatgcaaatgaattttacagcttaattggaatgatgagagaattgaaaatatgggcaaatgccagagaagtgaaaagcaaaatgaagcaaaacaaaaaagaacttgtataatatataaataatccatttcaactctacagtacaccaaactcttgaaaaagtagcaagattgtttttgtgaacagccaaatcaaaaactgtagtcatttcataagtatttgctaataattataaaagattggaaattatacagttctgagcttattgaacctttgacccattgcagtgtcctcagacatttgtgatacattggtagtgccatttaattttaaaaatccacctctacattagagattatagtaacccctcatttacctatctggaaataagagtgggaaagataatattagagtaaatggacagactatttagagtttatgtattaataaaagagaaattgcatgtacaaacatgttattttctaggtaactaaaacctagtcctttaataaagcactgaaaaaaattttatcgtaactattttaatgagaacttttcttgaatatcttctgttttgcttcattgagcagcgcataatatctaaccaacaaatttatagtgctttgtagttcacagcatttttaccatataaaatatctcgtttagtttctccaacaaagctatgagttaggtggtattattatatccatgtttcaaggatgataaatcttagtgacccatctcattttccaaggatcacacaaccagtagtagtgaattaggaacgaaacctaagacttctgattctaaatcacaatgtaaattaacttttcttaattttcaggggtgtcgttatcacatcaatttttgctctgtttagtgatacagtgttatatgaggaacatgaaattcaaagcaccctttcttcagttgagacccagttgaagtggttaatttgcttttagaagctagactgtaagataaatacatacctttaagtattaaagctaactcaaatcactgagatacttacaccatgagaagagagtggaacctaagtcaactggtagaaacatagaaacagcaaactttgatctctctttatcctcattctgaggggcaatatgcttactgagtggaaagatgggcatacccccagcagtatttaaatcaatccctaatctatcactatctctccttttctctctatctcagcacatataggtgatttcctataaattaaatggtgtaggatgagatttcatcccatgttgaaaggtcatttcattgataaatgactaagattaccacatttctcagttttaagtttttcatgttcattgtctcctattgctactttctgttatcagaatgattacttctcattgcttttagtattctgtctttgtagggttacagaaacttcacagggaaaccagaagatcaaatatattactcactagtctcttagaatatttaatttttagtgtttaggttctgatgtcaggacaggaaaatatcttccgtgagtgatgacttccaagggtggttttcctgactaatcagaggcattattttttgtttgcttttgggttcaagactgatttttaataaataaaaaagttacatttattgatatgctagtaaatatttacatcatgcattctggataaaaacattgaaagccttgatttgacttgatgtcagacacaatagacatagtctcaagagcactgatgatagttaaattaggaagtgatgaattcttactatatattatcttttgttcttagcacagtttattttatatttataaaatttaatttatattaatggttatgtttaataaccgattagcaaaattactgaaatgtgacaataatatctctattcctgtttctttcctgctttatccttttaaaatatattatttataagtatattttaaatttataaaagctacattgtgctataaatcttgtttcttagcttttctaacattcataattgtgttttaaagatccacccatggccgggcgcagtggctcatgcctgcaatcccagcacattgggaggccaagatgggcagatcatctgaggtcaggagttcaaggcagcctggccaacatggtgaaatacaaaatacaaaaattacccgggtgtggtggtgcgagcctgtaatcccagctaccgggaggctgaggcaggagaatcacttgaacccaggaggcaaaggttgcagtgagccaagatctcaccactgcattccagccagggcaacaacagtgaaactccatctaaaaaaaaaaaagaaaaaaatccatccacattgctctacatatacccttatccatttctttcacatacatacccatgttggcctcaattccccacaatgcagcaacaaactttcttgtacttccttatgaccttaagaatgtgagagaaacttctccggtatacactggtgagggaatatgatcagcagggttttttgtttgtttttctgtgttttgctttttaacttatgcccacctttctgttggcagtcagcagccacatctgaagttatagctctctgatttagacaaggcttattcttccctttgttacaacctagtccctatagggacctgaatttgtgaccctagtctatgagattactttttaaatacagtttggttcaggatttataaaagcctaataaggctgggtgtggtggctcacacctgtaattccagcgctttgggaggctgggatgggcagatcactggagtccaggagtttgagaccagcctgggcaacatggcaaaaccccgtctctacataaaaatgtatgtactcagtagtactactcagtagtagtactgagtagctactcaggaggctgaggtgggaggattgcctaggaagtcgaggctgcagtgagccgagatcttgccactgctctcccgcctgggtgacagagtgagaccctgtctcaaaagaaaaaataagcctaataaaatgattgcacgcctggaaaacctacataggctccttcaagtcccatatatatataaagtcatccatggtatgtagttcacattgaagtcaagttgggggaaaagaaacttatttatctctttctcttttcctttattcaagtagcaattttcatttaattttattcaattcagaaatatttactgaactcctcttattaggaagcactagactggatataaagaaaacatcgtacaaggcatagaggactcagtcctgccttgcgaagggcacatagtctgactggaaagacacatgctgacagggtagactgtgttaggaataatgctcaaaatcctgaggacattgaacactcgaacaaaggattcttagcaaagcaattttacttctgcacagaggggtgcctccttggccagttgccatgagagcacacctgaacaaaggggcatgagagcctttattcctgacgcaagtcctgcccctgtaccctttccccccattggctggggttgggtcgtacaatctaaactaatcccagttggctaaacatttgatttttttagatagggtgggcacgtaaaatcaagtggagaggaaggggaaggggcgtctgtaatgagctagaaagttagtcctctttccaaataaggaaatgaatgtgagctggtactgaggtgtgcctgggcatctaacaaaggtaaaaaggaaaaaggagaaaaatcagggggtactatgaattaaagaataaaagattgatcagattatttgaagagaaacctcatcatatcccacaactggaagaaacaatttgatggcaagtttctcttcgtcgtttaccagctcaaaatctcaactatcaaaggcaagaaaaatacacacacacacacacacacacacacacacacacacacacacacacacccctctgcctttttctgtatggccaaagccttcagtccagctgaccacttcccactccagttaccatgttagcctcccaacttgtatctctgcacccttctgataaagcctccacaatgcaaaacacgaatcgtatcatatggctcttcttctctaaacacttccatctactctgtggttttagaagagaatgtaatagtcccacattacaaggtcttaataaattgcattcttgcagctctgtatcattacttgtaaacactgtagtctagatagccaggacacactgcatttcttttttaaggctcgatacctcttgccattttgcacgtagttttccttctgtctgaaatgccctttttccacctggcgcttgaatggccccttctgaaaacttcctagtcgtctttcaaaataaattcaaatgttagcttttgtgggtaacctattgacctctccaggctgagttaagctgttcccccgaggtgtcttgttgaaatcattattttttcctaaaatctctgttctaatttacttacatgtctgtgaatgcttagaggttacgaacttcagttttgtaagcttagtaactggcacaaagtctggcacagagtagcacctgaacaattatttttctggaataaataaagtaatggtttcattgaaatgattcgcattaaattaatgattagcattaaactacaacgtgtatatgaaacattccagttaggttgggttcattccattcctatttaaagagtttgtagtttctggctcttttccaactctgattcttcagactagaaatgcaatttctgctaatgtatttattttaaccaaacccgacatcaatcaagttatttgtattcctcataaggtaagcataggaatttacagtgatacaaaaacgcagctattatctcttataggcactggtaaagcttttgtgactagtgctactatactggtaaggtattgctgcttgtaatgaactaaatatttcagtggcttaacacaataggagttcttttcttgctcacatgacaacccagcgtatgttttcctagtcaagcagctttcttacatatgttattgcagaaacctaggtcctgttcatcttcttcctctgcctgccattcccttggtagcttttctctgctcgggtttcgcaagaggatgaaatcctattgaaaatgatctgagggtctattatgttctcaagaatggtacatatctagtctatgataaatgctcaggtaactgattaggtgtaatagatatcttaggattttgtcatgaacaatcagcatcaacaccacctggaaaattgttaaaaatgcaaattattgggctccacccagtatctactaaatccagaactccggggctaccatgcagcaattagcaaggtctccaggtgattctgttgatcctaaagtatgagaacaactgccctagggcgttaggacttaattctctcctcagtaagttgtaaagatttgccgtaggacctaagagtcttctgcttccagcaatagaaaggaaaaaaaatgtggaaacctcactaaatttttcaaagcctcagccccaaactgacaaacaacacttctgctcacattctgctggctataaattatcgtatagctagctgcccagtgaagtggaaccagctcaggacggcctactgttatattgccaggcattttttgagccacttgatgttatcttcttggtaatttaaatttaaccgtggtaggaatatttacaccacagaaattggcaaacactaaaaacaaggtgtttttaaacaccctgagatcagagatccagttgatatacatctaccagcacaccactggccatatacaggcttgccttatgccacggggagctctgcagctgaagtagcccttcaaacttgtcctgctttgagccaaattaggcctctatactttcaccttcatcagtcactgaatgagggctgcctggggaaaggcatgaacttggacaaggcagctctctgcagctcaggcagtccctgaagggactgacagttgaagaatgtctactgacatcatttccatcatctagaacaagagtctttctttgaagggggctctgagtagcatattcccgtgtccactgcagcccctccctttaagagactctgatataattgactgggggtgagccagtacattaggattttcctaaagttatctggataattttagtatgcaaccacaatagatactcttcaagaattaagctagttgctgagagggaactgttttttgttggtttgttttcactaatgtttgcactctacttcctttaaataaaattatgcctggagaaagggtttttgtatggagcaattgataaatatttgtagggtggttggctaaaataattataattcctttaaaagaaattctacccactaaagttaatttagaagtaaaatataatagaaatccaataatatattcaccaaatggattaagatgttcatgaattatcttcaaagtgttaatcgaataagtaatgtgtatgcttttctgttaaagaggaagttagaagatctgagctctgagtggaaggcggtaaaccgtttacttcaagagctgagggcaaagcagcctgacctagctcctggactgaccactattggagcctgtaagtatactggatcccattctctttggctctagctatttgttcaaaagtgcaactatgaagtgatgactgggtgagagagaaaatttgtttcaattctaaagatagagataaacctttgtgttattgactgtgcaaaaagtcttagagtacattccttggaaattgactctgattcaaagtgttgcatgacaacgggatatggggagtgttctctggagatacacccacaaggaagagaagagcacaagggagattgtgggagagtctgaaatgtgatttgtctgcagcagaggcctaagccagtctcgcaggagccctacatctgggctggctgtgcagagctgtcctgaattgcaggcagtgggcctggcccttgtattcctgatccagccagccattggccaggggctggctgctgcctgagagtggaaggacaacttggacaagttttctgaggccgaaggcaattcttagtaaggaacaccattaacaaccaatattcctagcatccagggatgtgtgcattgttcctgaagagggacaagtatgtctacaaaaatcacagaaaccacagaaacacacacagtcctactagcacctctccctgtcccatttgcaaacaatttaagagctctcccatttttagttcaagaaaaagaaaaatggattgggaggaccacaagctgacttgggggaggaatatttcctcatttagctgtagttttaacttttgttttcactgcatattttcagtctattttattttctttcctcttcagttgttgatagaaggtattcataaattctcatggcaatgttaatgctggctttgactctcaggggaaagaggccagaaaacttctttgctgtaccattccataattaggcagaactaaaaacatctttgggtgttgttttttgtttttgtttttttttttgccttgtctgcttttcaaagatcaaatgattgaagcattaaagcatggtgactggttcttcaggtaaagttgatttttattttatgtcaagtagaaaaatactgaactggaagaatcacagctggggtagcacaatcataattcattagaaggcataaatagtgcttggattaaaagaagccctacaatctggggacagtgcatctcatgtgccctctgggattactcggcagtcatcagagttagatttaacgactttggagacttaagcattatggttttttttttttgtcaatctgggacactgaaattgctgtatcagggttatactcaactgtgtcaggtttatttgtttttatgagctgtaatttttggttccctcagcgcatatgcatagtttgttcctatgttatcatttattggtgtctgttttctggctgtctctggtaggttcagcctcagactctgtaactccatgaagagattatgttccaatgatgttttataagtttgttaaactctgaactcatgagtttatgtcccatataagccacgttacacatggtaggaaggctccaaaaccagggcgccgaaatccatttaacgtgtaacttacctaaatgtaacaatgtttataagaaaaatacattggaagttccagttttgacttccagcaacatatataattcatccactttatttattaacttccatgtgttgagcatcatactggtgctgcgagtacagcatagaataaaagtctctcctttcataaaacatatattgtaattgaaagagaaagacaataaactaatgaagaaaatatatactgtctcaataattataagtgctgtagagtgtagtctacagattgatgtcaatgggtatttgttagacacacagaatctgaggcccctatcctagacccactgaatcacaatctgcattttaatagaatccccaggtgaatcctgtgcacactgacatttgagaaacaccattacagagaacaactaagcagggagatgggatgagggtattattgtctatagtgtggtcagggaagcttgtctgttaagagaacatcagaaaactgatgtaagtgaggaagtgagcctggtgtatttctgggaaaattattccaggcagggagagaaaagactgagcaacgatactgaagtaggaacaagatgacggaatattaaggagatcagtgagactagaggagtgggtcaggggaagtgtgatggaagccatgagagatactcatctttcatagcactgccctacttccttctccccaacatgagggtctcatcaccccccaccactcttgtcttctcctatgtcctccacattgctgccagtatggagagtctgggaatgccctcagctcaaagctgtttggtgatagctggcagagttgtggtagtagctaaaaaagaattaagggaaagaggaattttctcaaaagcaggtgcttttcatcctctttagcaaaccgaaacagatctgagcattaagtcaagatgttaaatacacaaatgttgaatgaaaaaaaaaacaaaaggtagtcatttaaattcagagctgcttttattaaaataagattttcttttttctttactgtggtagttcaaatatcagaataaagaattgtttctattcccgacttcctgacttgcaggaagttaatcagaaataaatgcaatataaaaaaagaaaatctaatttgtattatgcttcttgtatatgtttattatttcatgtactgtattacaatgtaatagaatttataattcattatagcagattgtttccattgcattcctactattaaatatgtagaagctacacatatacttgtagctttaacatatatgtctttatcctcaaaataactgcaaagaacatatagataatttttaaagattaaggagcctgaggtttagaggggagatagctagattaaggccacacagctagaaagcaagcaagcaagggtttcagtccacatgtcaagctccacagcctgtgttttgttttgtggctgtgctttacactatctctctgtccaagaacctaatggaaaattacagatacagatgcagctggccagcagttaatataatttaactcaatcttaaatttatctggagtaaaagtgatacaagtttccgtgttttttcttttctttctttcttttttctttgtgtgtgtgtgtgtgtgtgtgtgtgtgacagaatcttgctctgttgcccaggctggagtgcagtggtgcgatctcggtttactacaacctctgcctttcaggttcaagcgattctcctgcctcagcctcccaagtagctgggatacaggtgcgcaccaccatgcccagctaatttttgtagttttagtaaagacggggttgctccatgttgatcaggctggtcttaaactcctgacctcaagtgatccgcctgcctcagcctctcaaagtgctgggattacaggcatgagccaccttgactggcctgtttctgtgttttttctacttaagaagtagaaaaaattggttcactctatttgaatttcttagaaccatagaaatccaaacttggaataattattgcaattattatctagttgagtattcttcttttatagatgtagaagctgaggcctaaagttgcttgttttgttttatgaacactaaaccaaactaccttgtggctgcttacttaaattataaattataatggggtggccttgcctgagctgtataaattgttttaattatcaggacaaatcaacatactggaaaaaaaaagcaaaacttgcaattgttgttgcttagacacctgtccatatcagtttctattgttgcatagaagcaccccaaaacttaacagttcaaaacgagtgatttattgctcataattctgtgtgtctgaagtttgctctgtgattagctggatagttattctgatggtcttgcttggtgttacttatgtggatgcagttatctagcaagtgaacaggagctagatggtctaaaatgcactctctcagatatctgacagctggctgttggttgcagaaccttgattcttcataaggccactcatcatcctgtaggctagattaggcttcattacatggtattctcagggcagttttccaagagagggcgggtggaagctacaagaccttctgatgcctaggctttgaaacgtgtaggttacttctgctaagttatattggtcaaagcacctcaaaagatcagcccagattcaagagatgaggaaattacttcatctcgtgaaaggaggagatgccacatcgcatatcaaaggggtatgcatattggggatagaaggttttattgtcaccgtatttatacacaaatcactacattggggaaaaggagggaaactggagatcaaaagtgttggtcttaatccaacttaattctcaaaaattaccatgcgttagaaccacccagttcttcgcaaagtatagattactgggcttcaaccccagagtttctgatttactagctctggggtgagacctgcatctctctctctctctttttttttgagactgagtcttgctctgtcacccaggctggagtgcagtggtgcaatctcggctcacagcaacctctgcctcctgggttgaagcggttctcctgcctcagcctcctgagtagctaggattataggcacccgccaccacgcctggctaatttttgtatttttagtagagacagggtttcaccatgttggtcaggctggtctcgaactcctgacctcaggtgatccacctgcctcagcctcccatagtgctgggattacaggcgtgagccactgtgcccagccaagacttgcatctctgaaaagttcctaggttatgctgatgctggcctatgctttgagaactactaccacagacatacagtgagtggggaagaataaattcatcccttctgctgtgtgcagcaaggagtgggattccaatgagatccagtgctgtgaatgctaaagggaaatccatcttattttagcacctctactccccatctccccaccccgaggatgttatagcttagaagttcaaggagatggacaacacactaaaccaggcagtatttgccctgcagagctgttcagtgttcctggatgagacctctgagaagaaaagccataagttcctctagagactttcacaatcatttaggtagacaggactttgcatgggtctgaaggcttgcatggcagatggaggcaaagagccagcaaatctggttgtaaatgtcaatgtgaatcctttcttatccacaagctgctgggcctgagaacattaatgttctacaatacccgatttagcatttttgaaagaaattgcatatagacatgcttaatgtgaagactccaaatcaggatatttgattcaaatgtctcttggtaataactatggaatgaataacccattgtatatggacatatagaagagccagttaacagagttttctttttttttttttttttttttttttttttttttgagacggagtctcactctgtcgcccaggctggagtgcagtggcgcgatctcggctcactgcaagctccgcctcccgggttcacgccattctcctgcctcagcctcccccgtagctgggactacaggcgcccgccaccacgcccggctaatttttttgtgttttttagtagagacggggtttcactgtgttagccaggatggtctcgatctcctgacctcgtgatccgcccgcctcggccttccaaagtgctgggattacaggcgtgagccaccgcgcccggcccagagttttctagttgattaaacactggtaaaatcatctcttcctgtaattaagtttggagagagcaagtctcaagtgtaattaggaaagcacagtattggaggtcaagaagcctaaattctgatatctcagttgtgctaccaactatataagggatcaacagactgtttctgcaaaggaccgatactagatattttctgctttatgggtcatgtggtcaactctgtcattgtatactaaaagccacagacaatacctaaataaagggacatggctgtgctccagtgacactttatttacagaaacgaggcaggtaagatagatttgacccttagtgggctacccatttccccttagcactcagccttcctataaaccatgaagcgtctaactacaagtacctgtgagtcttcctgagtcctttctctgcctgtaggagtagctctcccacttgcagagcaggctggaagctggggaggagattatctctggaatagcacttaaccaatggacaaaagctgggggataaaggtgttggtcttcatagttttcatactgctatgaagaaatacccgagactggataatttatacaggaaaaagaagtttaatggactcacagttccacatggctggagaggcctcacaatcatggcagaaggcgaaggaagagcagaggcacttcttacatgacagcaggcaagagagcatgtgcagggaaactgctctttataaaaccatcagatctcatgagacttattcactatcaggagaacagcacaggaaaaccccacccccatgattcagttacctcccacatggtccctcccacaacacgtggggattattggagttacaattcaagatgagatttgggtgagaacacagccaaaccatatcaataaatatcccaccttcttctccccttgggtaggacacctccaatgcatgttccacactaaaaatctccagtgaattgggcagttgaccacaatgataagcatacttattagcatgcctcgtataggcttccttccgatgtgtaggctttcttcccattttggcagaatctggacccaaccccacatctcctgagtttgatttcagtcctcttcagtattctcatatatctcaactttgttccctgctgagatacaactgacagatatatatgtatcttcagctctgcagctctatcttctcttctaccatggctttctgggatcagctcccaattgaattatttgtatttaaatccttgtctcagggtctacttctgagcaaacctaaattaatacaagtcttagaattagtgccacagttataccttttgagtaagttatgttgcaattcccattttatagatgagataaccaagggtcagaaaggttaaataatttgtccaaggttacagagctagtcagtgacagagtgggtattcaaaaataagtctctatgattccagagcttatgctattaatcagtgcaccatgtatcaagcagtgatttagttatcttcatttgaattttttgaagtctctatttaaattgaatatcaaatcctcacatataaggttatttatacctttttatttgttttatttatttatttatttttgcttaacttttttttattatactttaagttttagggtacatgtgcacaatgtgcaggtctgttacatatatatacatgtgccatgttggtgtgctgcacccattaactcgtcattgaacattaggtatatctcctaatgctatccctcccccctccccccaccccacagcaggccccagtgtgtgatgttccccttcctgtgaccatgtgttctcattgttcaattcccacctgtgagtgagaatatgcggtgtttggttttttgtccttgcgatagtttgctgagaatgatggtttacagcttcatccatatccctacaaaggacatgaactcatcattttttatggctgcatagtattccatggtgatttatacattttaatttgaacttcactcacctctacaaagttaaataaagcattccatttccatttcaataatactttaaatatctaggcagttaaagcatgaggttacttggcacttaaatgtactcttgtcatactacttttgttggcttaaattgcaaaaaaaaaaaatggttaatttattgtgacaataccctacatttatctgcagtgatcattttttttgtgaaaatggccttcgtttatctgcagcaaaggaaaaagaggatggcaattagttcttgcattcttattcctctcttgggtcctgatccttctcattaatagaaacatggcaggggaggggtatataacccacaccctttcctgttgtggttatgtttccactgttgattctgcttcaggtgaacctttaggattaggcaaataaatttccgtgaggccaaatctttttcttcctcattaacagatgatttctctgctaaaaacacttacgacatggctatactattgccggttttatagttacaggctctaaaccttgaaaacttcctcaaagtctaatacgtcaggagcaagcttttgtacaaaaaatgtgaagacccttaatcagttccaataacaaaataaatccattttaaaccctatcccaagatactgcaaggccttggagcagctggagagactccttaactcttgacattaattaattaatttaaaaattcatatttgtatgtatcagtgaggtaagagtgcttgaaatataatgagatgtgtcacactgtagaaaggggagtgacaacagaaagccctggctggtgaggccccagcacttctcacactcatcagaaggaagtctttccatgaaggcagtagggggtccctggtcccaggccaggtccttcaacaatgctcactggttaacaggaaaggcactacagtggcatcattgttaacatccaagacagtgatagaatgtgaaacttctactgtttagtatttagtattcagcatttagatgttaattatccattttgtgatgaagttccctttcttctccctctcttaaccttttggtagttttattgcatggttaccatttccagttagggttgtgctttggggtctgaactgatgaaggaagagaaactctagttcatcatttctaggaaaaagagaaggctaacatcaattctgatgattagagattttttgattacctatgtcctgcattttaacagaaataaaatgttaattacagtaaacttactttaaccttcttatgctatttaacactcttcaagaaaggacttttgcttgaaatcactacagagtataccataatcttgactgtcatactctgaccaagaaaccagaactatttaggcatatttatgagagtaagtaccctaccgctcaaaatggaaggcttcaacatgtattcctaatatttcctaaaacttcactgaatagttttaaaattgaatataactttaccttcagagagaaacaagatttcgaaaggaaattgtagcagttttgtacttcaattgtcgattttaagattgtggtctgaaaagtatttgaacagtcattctttcttttccactatctcaggaaaggctctcattctattagaagcaatcttagaagcgtaactgccaactctcttcttaaaaagtgaagagcagatggagttctaccaatctgctatacttgacagtttttcaactacctaacctaagttccagttactgtctaaattatttttattcgaataggaaaaatacatttatgcttactgtacatttcgacagtgttcattctttgaggtctgttatttaatctccttcccacttttcttttctatcttaaatcagatgagtccccatggtctggcaacaaaacagctgtttctcaaatttttaacgtctctgtggccctcctcctacccttccaagtgttttccatactatttttctgttgtgggcttcagaattggatgctgttccataattactggtcttcccatgactctgtcacatcataaagtctatatatacccttttcctacgtttacatgccaaataccaggtgtgtctagctttaattcaatgactagcatatggtaggtattgcactaatattttttggtcaagtgaacatatattttacagatagatcaaatacatcaaccttcccatgtaataataataataccaagaagattaaatgatcgcgtgcttgaccagctgtttagtggcagaatctggacccaaccccacatctcctgagtttaatttcagtgctcttcagcattcttatatatctcaactttgttccctgctgagacacagctgacagatatatatatatatcttcacaatctcagtagtaagccctatttttttaagattacagtgctgatcaaagagggatattctatggcattgatgcaaatcttccaggccagatataacccctatctccttaaaccctcattcttgactgtgtcttgaaatcaaatttgagaacctctgctttacatgctaccttcctcttaaaattcataaggtttattccttctctcatcttcagtatttttatgaaaatatgttttactcttatttccaaagtgcttgccagcccatgctgagttcattagacaaacaatctaggtatcctaatatttaggtaaaattgctagcagcactaactataccagtacccacttaaattgcaatataaacctacaataggaaaaaaaaagtcaaaattatactactttcaattcctacttctggaataattatcacaccttcaaaaaaactcataattgttctccaatattaaaaaccaggaactaaattacatcactatatatatatagctatatagacatataactgtatatagtttatatatatattacatgtcactatatatggttatatatacagatagctatatctctatatagtttttatataggaaactatatatataaactcatatatatttatatataaactcatatatatataaactcatatatatttatatataaactcatatatatttatatataaactcatatatatataagagattttatatgtatatatgagagacaatattgaaataaaacaaactagccaatctccaatgtcccttcattttcccaggactcttctttattctcaaagaaatgtatgaatacacaatataaataaatgttctataatgttcattatggattataatagttttcttgtcatactgaagtgaatgggaattgtttcttcgattattagcatacttttcataactatgtgatttggtgataggcacttttgcttactaagttcagcatgatcaaaacagaactcctattatttttattgttgattcttatttctttaaggtaaaatatgcccttttcctttgaacctgcacactgtttaacaaataagcacataactcaggattgaattgtacacttcgatttgagcttttttttcaaggtcaggacccagtttcacaagaagttttattttttccaatacaactgacatccactcccaccagctgaaagacaagaaaaacttgtctaataaagctttcagattcaatttgctgcctgcatacagcttgaggaatctctggaggtcactcacagcatgtgttgcaaccccaacagggagaagtaatgaaaagattctagttaaaaagctgacactgccccttccaacctctttgaatgtgaatataataagccagtttacagacgcaaatctctatgattctggggatttccatcttgatctctgactccaaggaacatttgaatgcatggatttgtatccattatctgggtgaataaatgcttcatattgaaaaaaggggtgctttaacaacataagtctgatgtaaatcaggcaaaacaacattgtcacttcatgtttaactctcctggagggtctctaaggtctcacagtttggttctattccagtaatatataggcctatcatagccattttcaaaaataatacctgctttcatttcgattattccccctagcttttgcattgacccgaacatacctaatatttatcttagggctaacacgcattaatgccttgctctgtaccaggcattttgccaagtattctttgtgcatttttctgtttaatcttacagcagccttatgaaataggtactacattattattatttttcaccatgagaggaaatgaaagcctagagagaatggttatccaaaaacacccagctactaagtgggcacagcatggccttgaacctgagtctttataaagttcatgcctgtcttttacctttatgttaaacatactgaatcttggtcatgcagtctatgaatgaagactccatatactctaggaccaattctaccatattgtgcatgcttttgtacatattttccaaatgaaattaaacaacaatactctctcttcccctttcttttccgttttgcatgacatctaaatcttttattaaatctccgtgggtggaattgggccttaagtagtagtacctttgaagcttaatactataacctcagagttacggaagtggtttcaatatgaagaaatatatacgttcttttcttttcttttcttttctttttttggctcctctagaatagaaggcaatcaggagagaaaaagacattaagatgataggcttgattctcccacagtgttactacttagctttatttattctcccacatctgtaactgtcaattcaaggtcaaaaagccagtacagcagcagaattacaaaaagtagatctggaaaatctatagggtaccatagtccagcaccctgctgcaagtcaaaatcaattaaataaatatgtttaaacagcacttcatttaatcttaagggcaccacgactcccttggaaaattcttttttgtgttcagacctgattctctgaaagtattttctagtgttttctttgttcggtggctgtggtgaataagtggacccaattgcctacagcatgaaatcgtagaaatgaatatgggctggaacttcaatcaatcacacaaaccagaaacatagagttcatcacctcttctggaaagcgtccccttcggccgtcaaaagggtagagtttcctccaacatatgttcatacttccctttgcctcccatctgcaatttcaaccagtctgttgctctcgccctttttaggcttcacataccggatttcttcttaggagctcacttgaaaaaagggttgtatgctttaaaaatactaaaagtcactggactagatgataataaaatttctgtaaaataaaaagggagttaacagaggtgttaccacttatcataatggatattgttgacctttcctctagccagtgtcccacttaagcatgcttcttggctggaatttatttttctcatctggataaatctgaagcattatagtaaaacccagtgtgagcaaggccatggatgcaagtggattgagatgaatgagtggatagacctgcgtgggcagaaataatgaggtcagcaataagccataccaagggatgcacactcaaggaataaattggaggtagcagaataactgaacaaatgatacatttgatcagactgtcacatgaatatcaactgaaacaagttatgactgtagttagtgaaccctagagtgaagaaaacaaaatattgaaatccatctgatcaaaaaataataaaattgtttacatgtatatattatctaaaatttcccttaagaatgaagattataaattcccgcagttgaggaaactgaataagaggagaatcaggacagaatcttttctcttcgtattcctagtccatttttcttctaactacagtagtgagaacaagaatttattcaccaaatcataatacattgcaattaggggatgccatttgaatcttggaagacacgatttgaggcaaataaaaaatccatatttataaagtcaattattggtttatataatttactgtttcagcgggaggtataggttagtaatgtaagtcacttcaagaaggttttggtcgaagttttgccaattttttctgtaaaaagccagatagtaaatattttgggttttacaagccagaagatctttgttgaagttactcaactctgctaatgaggtgcaaagcagccataggcagtttgtaaatgcataagtgtggctgtgttccaataaaagtgtgtttgcaagaacaggcagttggttggatttggcccacaagccgtagttcactgacccctgttttagataaatactagtcaatagattccttgtagctaataaagggaatatagattgtttaatgtgtttccctaatcttcttaaggcttcctccaggggaaaaaatatttcttatcatcagcagtgttattaatgcttactcagaacaaagaataccacttacttagcatagaatggacatttataaagccactcatggaaagaataaagagatgtgaaatacctggtacaactcttaagagtgttccactatcatttgaaaaaatgatgagtagtagttatataaaaggactcgagcctaaaacatttgttctcactttggataacgttttcctatctcagcatcaaaaaatacaaagaaaggggataactaggtcttagattttctaaattctcatgactataagtcccatatatttagatattgaagtacccttaaatatacctaagtagaagtaataatttcgatattatgggaaatctaattactgctcatagttctcgagattaaaatgttatacaccacatctcagctttctttgaaacttgaaatggcatacttgtacaaaggtagaatggtctcccaaagcagcgtcatagattagcagaaaagagctatgataatgccacttcaactgactatcatttaaataatgaattagttaggaagagttaaattatatagttacaggcagcaggagatgtcaccatcagggggataagaagccattttccagtacactatttgacttaactggtgcagttccttctttaactgtaggttactcatttgtatccttaatttatcaatatactaatctgacaaataatttattaaggattactgtgtgccctcctgtgtgttagattctagggatacaatatggatcaagataagcgtgattcctagactcctagaaagtaagaaaactaaataactgtacgtgacaaatactaggatgtagaatactagggaagaatcaggaagaatcacctcacccagtctggagtattgcaacagagcgatgtcagaggaaaaattctggaaaaaaaaaaaaaaaaggaaatttgaagatgagacttgaaggataagtaggtgtacctaggcaaacaagtaggggagagtgttccaggcaagagaaacaagtaacagttggaggcaaaatggagcctagcacgttttaaaaatatcagtatggctgaagcactgagttggggttgggaatgggtgaggagcgatgtgtcagggaggacattccagatgatgctggaaatgcatgcatgttcgcaaactgcattttaagacatgttagagaaatcaaacacattttatttgaagggtaattgaaagccactgaagcattgtagagagactagtgacatgagcatatttgggttttagagggattactctggctgaagaataggtaactgattggataagagcaactttggaggctattccagtggttcaggtgatagataataatgacctaaactaaagaagtaataaagggaatggagacaaagtagacagattcaagtgatacttggcacgtggaaacaacaggccctggtaactgattggacataaaatggagagatacagagaacgcgaatagaacacccaggcatttggcttgataaaccgagtagaccgtggtagaaattactaaactatggagtattttagggttcaggggaactgtgagttcaattttagacatctagttttgcaaggccactgaggtaactgagcatatgagtcaggagagaagtttaggctaaaaatatggatgccagagttaaccagcgttatgataaaacaaagctgaagtctcgagggtaagaacacctaaacatctaggctggagaaggcagcaggtaaaaagtaaaaggagaggccaggcacggtggctcacgcctgtaatcccaacactttggggggccgaggtgggtggatcacctgaggtcgggagtttgagaccagcctgaccaacatggagaaaccgtgtctctactaaaaatacaaaatcagccaggcatggtggcgcatgcctgtaatcccagctactcgggaggctgaggcaggagaatcgcttgaacccaggaggtggaggttgcggtgagccaagattgtgccattgcgctccagcctgggcaacaagagtgaaactccgtctcaaaaaataaaaagaaagagagagagagagagagagagagaaacagagaaagagagagaggaagacaaagaaaggaaggaagggagggagggagggagggagggagggaaagaaaagaaaaggagaaaaattcaggagaatggttacttccagggagatggaggcgattgtgctgtggggaacacaagggtggggtcaaggtattagcagtattctatttcttgattggggttgtatttacataaagtgttgctttataattattcttcacactttatgtgtacgttctatgtaatcatctatagataagacagatttcactgtaaaagaaaataaaagcttccaaaagattatcatcacaattgtaacagattcccctggtgcctggagtcacacgccattttcctgcactgcagttgcagctgcagtggacagccctgtgtgagttcagacttgcctttagctgacagcatcccatgtcaagggaatggctcccatttttctactttctatctaagggacttctctgacatcccaggagcccacagattttgtgagctttctcacccttgaagttttagtgagtgagcaaccttcaaccaatggagatgggagcccatggatatatttttaaccactattccttccgggggcaaggggaattctctgtgattctcaggaacatacaaaagttctgtcaaaatacagtccccatggtccataagcattaccttgatgataatacatttgattggcatttcctccccctctgtctcactcttttggtttttcattcttgcttcctagggatcagcttccaaatgagctatctgtacccaagtcctcatccaggccctgttttcaggggacccaaagacaacaataagaaaaatggaactgaaagaggagaagactttaaggcatgaaaaaagttcctctgtattccatactgcatatttaactgcctactcaacagttccacttagatgtctcaaaaataatctcatgatcttttactgctatgaaatgcatgaccttcccctgatatattcctttcttcaggttttgtagcaccacttagctatccagtaacaaaatcttgggggtcattcttaaaaccttcccacctcacccctgctggacatccaccactaagttcagttgatttttttgctcctaaatatttcttggttcagctttcatttttagatttatcctgcatacccctgtacaatctcatcatctctttcctggactgttacagtagtcttatattaggatgatcatagtcttgatttgcctagagaaaacatgctttatgtcattgcctcagagtgactaatagtcccacctttcacttgtaacactatgcaggttattgggttaaataatactgtcatccaaacctaatctctcctcattcatttcttctctcctatgcatcttagctgtgtgaaaattcaaaatataaatttgatgacagacagaactctgtttaaaatgctccagtaccttaccatttatctcaaaataaaaatttcaaaaaaagaaatgatatcccacaggatcttgtatagtgtgaccctttccatttcatcatccttataccagatactgtgaactacttactctcttatctccacattgacctccctcctagttttgttttgcttatgaaagtgcttattttctgttttttaaagccattgcacatattggtctctctgattgagacactatccttttgaatttttgacctcatacctactcacttttcaggtctcagctcaaatgttatactcaggaaagacgctccttacctcccaaactaggttagtgtaaatggcactatttatactcctcttccagagcacacaccaaatcttatatttatttgtgggacaatttgaattcatgttgttccccctactcaattgtgagcttcttgaggacatactctgcctcctccttacctagctttattgaagtataattgagaaataaaaactgtatgtattcaaggtatacaacatgatgattttatatgactatattgtgagatgattaccacaatcaaattaattaatacatctagcacaagaaatagttactattgtgtgtgtgttgggggggggggatgaggacacttaagatccagtcttgtagcaaatttcaagtaaacagtaaagtattattaactatagtaaccataatgtacattagatccccagacatcttataactgaaagtttgtgccctttgaccaatgatatggtttggctgtgtccccacccaaatctcaccttgaattgtaatccctgtaattcccatgtgttgtgggagggacccagggggaagtaattgaatcatgggtttgtttccccccatgctgttgtcgtgatagtgaatgagttctcatgagatctgatggttttataagcatctggcatttcccttgctggcactcattctctctcctatcaccctgtgaaaaggtgccttcctccatgattgtaagtttccggaggcctctgaagccatgcggaactgtgagtctattaaacctcttttctttataaattacccggtcttgggtatttcttcatagcagcatgagaacggactaatacagtaaattggtactgcagagagtggggtattgctgtaaatatacctgaaaatgtggaagtgacttggaactgggtaagaggcacaggttggaacagtttggagggctagaagatgacaggaaaatgtgggaaaatttgaaacttcctagagacttgttgaatggttttgaccaaaatgccgatggtgatgtggacgatgaagtccaggctgaggtggtctcagatggagattaggaacttcttgggaactggagcaaaggacactgttgctaagctttagcaaagagactggcagcattttcccctggcctagagatctgtggaaatttgaacttgagagagatgatctgaaattggaactttgttttaaagggaagcagagcatcaaagtttggaaaatctgcagcctaacaatgtgatagaaaagaaaaacccattttctgagaaatacaagctggctgcagaactttgcttaagtaaaggagccaaatgttaagcgccaagacaatggggaagatgtctccagggcatgtcagaggtcttaatggcagcccctcccatcacaagcccagaggcctaaaaggaaaacatggtttcacgggccaggcacagggccgtgctgctttgtggagtctcaggacttcgtgccctgcataccagctgtggctcaaagaagccaaagtacagctcaggctgttgcttcagagggtgcaggccttagtggcttacatgtggtgttgggcctggggttggacagaagtcaagaattgaggtttgcaacctctgcctagaattcagaggatgtatggaaaagcctaggtgtccaggcagaagtttgctgcaggggcagggccctcatggaaaacctctctgctgggacagtgcagaaggaaaatgtggggtcggagctccacacagagtccccactggggcactgcctagtggagctgtgagaagaggaccaccatcatccaaaccccagaatagtcagaaatgctgatagtttgaaccatgcatctagaaaagctgcagatactcagtgctagccatgatagcagctgggagggggctgtaccctgcaaagccacaagggcagagctgcccaaggccatgggagcccacctcttgcatcagcatgacctggatgtgagacatgtagtcaaaggagatcatttgggcagttcaaagtgtaatgactgccctattggatttaagacttgcatgtggcctgtaacccctttattttggccaatttctcccattcggaacaggtgtatttacccaatgcctgtaccccccattgtatcctggaagtaactaacttgttttggattttcaggctcataggcggatgggacttgctttgccttagatgaaactttggacttggacttttgggttaatgttggaatgagttaagactttgggtgactgttgggaaggcattattgtgttttgaaatgtgatgacatgagatttgggaggggccaggagcagaatgatatgttttggctgtgtccccacccaaatctcaccttgaattgtaatctccaaaatccccaggtgtcatgggagggacccagtgagaggtaattgaatcatggaggcagtttcccccatgctattctcatgatagtgggtgatttcacatgagatctgatggttttataagtgtctggcgtttcccctgctggcactcattctccctcctgccaccctgtgaagaggtgccttctgccatgattgtaagtttcctgaggcctccccagccatgcagaatggtgaatcaattaaaactgttttcttcataaattacccagtctcgggtatttcttcatagcagcatgagaacagactaatacaaccaacatcccctcttgtcgattttcattgaatccccattacctgggaatgaatgaggaaggcagaaatagaaatcagcgtattgttcaatatagaaatcctgaagttacacaagataattacgagcaagactcagtacagagaaggaacccttgagctggggatcagagtcttctggaaacaaggagtaccaaaggggagtgaaaaagagaagtggagaatgagtagtagcagtaaaagaggaagtatgtaaagaaatggaaataaagatgaaataaactgtcatcttgttccagagacaaagctagctaggggagctaaggaaatttagagggataaaaagtctcatccaaaccttcataatgagctaagggctagtttttcatagaccctagcccaacttgcaaccctctcactctcttacttttttcctggctctgttttgctttactgcctttcatataatctaaaatgatgttaaatgtatatttcctgtctcttttctatatcacaatataaattccatgaggccattgcctgtgccacatttaccactgtactcccagtgcctagaatggtgcccagatcaagtagactcccagagtgtctgttgtcaaatgattctcagtccagtgatgtttgcactacatggtgctgccacttttttttttttttttacttcattccatttggaatttggatcattttgccaactttagggtttattcctctttatttcccctgtgtttgctgaatatctgactatctatttttctcagctctcttctcctcacactttgcctccaacttcctctctgctacaaattatacttagcacaagactggagccacttttcattgattttgatgtcagtgcttgagtgacaactccatgtggagaactttcaacctcctgctgtctcgttgtttgctttgaaaaaaaaaaatactcatcttcttcctgaacccactgggtaaatttatgctcacaaaaaagacaaaacttctagaacaaaaactgtatgagcttcaaaagtattagttttcccttgattttgagactcaaaagtaccatagaaattttaaaagggggatgaagtaattttgtcattcaacccgatatattttacaatttgaatgtcagaaccatgaaatgtcttttcagtgtactatcatcctcactatttccacctataaaagaaaagcaaaaatattgtttgagaacaaaaaaatattgcagtagcggaaaaattcactttaagtctttttttggaggttgccacatcacgcctgtcttcagctcctctcactgaagattctttgttttcttgaaaccagttggtcacttccaattcttaccacctataaatcttcctggttctttatatttcactttatatgtcccttatctcctctgatttttgttccagtctttcattttttacattctttgtcatcctatatgtcagaaagaatctgccactccaaattccttaatatatttatctaccagtgtttatttgcctgtcacatgtactcttcagtaatccattgacttgaaaactttctactctgtctttcttactatagtttgcttcttgagttcaaattattaatatattaggtcaagtaattctatttttatgcacattttacctaacattcttggtaaatataattgttttttaaattgcatcacatggtgagtattaatttaagacgtaattagtattaatctactggacaagattttatttattaactgttttgccctttgctagggttctgtaatctcaccctcagtgcctttaaatagtcttacccaaggatcacctatccctcttcaatttaaattctctattgtgttagtttctgagattgcacattctctggtttggtttggtttttcagtgatctctgtggtcacttccaaccatttctacttagtttacttttttccctgttagccctcttcagtgttaatatcacctggaagttaacccattcctagtctgcattgctctatggccagcatcttggctgattggccatcacctatcctgtacttattgtcaatttttttaaattttttattgtggcaaacagcacataacggaaaatttaccatctgtctttgttcatgtatgttgctataaaggaatgccagagactgggcaatttataaagaatggaaggtttatttggctcatggttctgcaggctgtacaaaaaagcatggcaccactaccaacttctcatgagggcctcaggcttcttccattcatggtgaagggcaaaggggagctggtgtgtagagatcacatggttagagagcataaacaagagagagaggggaagtgccaggctgttatttggcaactagctcttgcagaacctaacagaatgagcagtcactcaacctgcccccaggaagggcattaagccattcaagaaggatccacccccatgaccccacacttcccgttaagccccacctccaatattgaggatcaaatttcaacatgagatttggaggggacaacatctgaactatagcattatcttaattcaaataattttactaccaattccatttattagagaatctaagattaagactactgaaactatgccaatgattatctctagttcaggcttctctcttcaattccaaactcatattttcacctgctgacaagctaccacgtagatgttccacaggtatttctaactcaggatatgtaaaattgatgttatcattattttctgaaaatctattcctcttactatattccctatttttgtgaatgacacaatctaatggactggccatgttaaaaatcaggaagtttttctggcactttctttattccttaatattaagccccacgataaattaccaatcctttcgatcttgttaagacaaataagcttgaaatttcttatctcttatttagcactgcaattttgttttctcattcattcagatagcatcttctacaaaacctcttcactagtttttctgtctctcagctcatcttgtacactgcaaatccattaaaactacactttttaacatgccaatcataatgtattagtaaaggttgtataatagttctctttctcttctaggataaaagctaaatttttcagcttggtacacaaggccgttcatggatttggtacctactagtctatctagggtatttcctacatcttccctcctctctcttgaaaaatcaagtaatactaaactatttgtaactccctaatcaccaattgctgcctttatactttaacatatattcttccttttgctagaaatacatttgtcataataggctctttggtaaacttaccattacattctcagtttataatattatttgtgtaagtaccttttttcctacttagtcctccaggggaatgcatgtgcttctctctccatattatcattttaaaatttactcctatttcagcaagtatcataatattttactgagattaattgttggcatatttatgttaccctggtgacatatttaatagttaagatgctttgggctgcaagaaagagaatgcactttcaaagtggcttcaaaaataagaataattcaactcacataactggaagttcagaggttaaagctggctccagatgaagtacaagcagagctctgtcactctttctctatgactttctttgtcctgatttttttctctgcgtcagctttgacctcctcactagttgccctccaggttccaagatgactgccagcaacaaatgggtaacataatttcttgttacagtgagagacataaacacttacctcacagattcagagatttcaccctcagataagaacaatcaaaattttaattgtgtatctactgtatcattagtatatgtattaggtattcatatatatctactattgtactaaagatgattcagaatggtttcataagctggttgatttaaacttttcttcctgaaccaagaggatgagattatcttgactggcttagaatcgaagatttaggtgaatctaaatccatctccagaactgaggatggattccgtagaaacttgaagacaattggaattctcctagaaagcagaatttcagagtgggtgtagggatatctttgaatggaagttgtttaagccaccaacaatattcactccattggggtgacactgggcccaaaggtacccagttaatatttgttcaacgaacctataggaagacaatattatctgcaagctatttataaactaaatgacaacgagaagtatttttagaaaagttaatcatatacaatttagtcattcacattgggaggctcttcctaaatttcgtttctgatccttatcttgatctttgacgcaatcatatcttggcctccatctaaaagccagtagaagcctctggccattttttaaacaattggtttaacaacattaattggaatctatatagctcaacttaaaaaaaaaaaaaagaggaactagcttatcataatacaatattgtcaaggcaagtgatacttccatgcagctattcagcatttggtgtattcttggtttctgcagacctaataaaaagagattatctcagcgtcctctaggtttaattttaaaaaacaagaaaccatgaacaatgaaaatgatttcaaaacatcttcactcacatctaaaatatgaaatagctagatcagaggttcttaataatttaatcggtgaagcataactgaaggatttagaaaaagtgcctaaactattaaaagattcttcagctgctgcttaatgttgatatcaagttattttttacactggcaaacagctaagccattccctggtcacatccacttttcagcatttagcgctcctctcaatcatcccgatcacagccccaggaatgtttcatggcatctccgcaataatagtatattactattgggtcctgaattttgaggtagtttatctttcagaaaggatatgaatagagcaataagtccaagtagagtgggctttattaatgatgcccaagattttagacgtatactataatcttcaatcaattttaacaccacttcccttaccctagttttagtctaaaccagtccaactgtgctgtagtctcagataatacaatgttagattttttttttcaagatatagaattgtcgggaaaacttgtatgtaacctataccaatctaaatttcttagcatttaactctaaagagtaaagcttttagcacttcctgtgtaatacaagggcaagtgctgatttctctgaatataattttcctttgttagcacatatgttcactgtttaataaaaataagaatgcttcaattatctccttttgtcaagggcctgagaaataaagaaatatacagagggtcccaatctaaaaatgttttgatttacaatggttcggcttaggatatttttattttacaatggtgtgaaagtaatatgcactcagtagaaatcatacttcaagtactcatacaactgttctgcttttcatgttcaatacagtattcaataaattacatgagatgttcaacacctttaataaaataggctttgtgttagatgattttgcccaactgtaggctaatgtaagtgttctgaccatgttgaaggtaggctaggctaagcaatgatgttcagtaggttaggtttattaaatgcatttttcaatttatgatgttttcaacttatgatgggtttttcaatttatgatgttttcaacgtatgatgggtttatcaggaaataatcccattgtacgttgaggagcacctgtatcaatataggcatttacacaactctcgtactgatagcggcaggaggcagagaagctctaggcagaaaagggatggtccccagcgaaaaccccaccctcaagccaaaaagcctgaaaccgcagctcaaagtgggaacttatatcccagttttcctgctcgaatgttgcctttttctaaaccacccatggccccaccccaccccatcctgtgcctataaaaaccccagactcagctggtagacaggactacagctggacatcagagagaagcagcttgacttcagagggacaacttgatggcataactttagagaagaatccggctggacttcaggggaagattacttgccacccccatccccttttcagctccccttcccactgagagccactttcatcggcagtacaatccctcacatttacaatccttcaatttgttcatgtgacctcattttccctagatgctggacaagagctcaggagccacaagtgtgaatacaaaaggccctttgcccttgctggtggagggcagctgcctcctgtgaaaagacaaatggcccactgagctgttaacgcctaagctgtccgtggatggcagagctaacagagcactgtaacacaccctctggggcttcaggggtcgcagacgcctccacctagatgctgctccagtgctcatgcactccagttcccacctcgtttgcttgcacactccctccagtgaggagttgagagcagtgggctaagtaaataaggcacccctgttgcgagttccacaaaggggtcagggaaatatcctgcttcgttactaagtaggtataaaccctttactaagttagtaattattcagtaataatacttaaatgaaagctattctgttagactaaattcagattatcaaagacacgacagaaaacagctttctcattcatgaacctattatttccttttgtaaaatatgttaaatgaaaatacagccgtcatgctaatttctaatggtagaacatattttgaaaactcctttatgtttggaagattttgctttagtgcagataatcagaatgatgtgatatactaagaaataatttttaaaatgagatgtgacatttctcataatctaaataagaaatggcaaaacattgtcctaagctaaataactcatatgaagtgataaaatattgctttctaaaggtccatgatatgtagtgatttctaatgtgtttaatagcattgatcctattgggtaattgggtggttctaacatgtaaggaaggcctccagtactaatttcatgtactgggaaactactgggcagggatgaatcccttaactcctaagtaagactatcagatcatataaatctgctttttgatttgcaaagactcttaggcatacctcttgagaatattaaacatctactaaattatatgtaaagcatttcagtctaagatttacaatgctcaaaggagaaagattttaaagttcagcattggaatttccataatttccttccaattgtagaattttacaattgagatagcaaataataatataaataaatatgtaagactgaaatcaacataggagtttggaaagaagactgtatgggttaactagagttgtcaacaaagacttcacagaagattgtgatcgtagacattagtaaggaataaaatgggtgcaaaaaaaagtctaagaaacaacaaggataaatttattttgtaaagagtgaaagcatattgggtattacataaagagactggctagtttgacacaatgtgtacttttggggtaagcagtgggaaatcactttctgtaagtaaagtggaagagaattcaggtattggatatggtcatataggatttttcaacctttgttttgcccccatccctatcctaccagtatcatcacagatgttggcaatattcactcacttgcctgaagatagatattcatgtcaggggctacagatatgtaaaggtgaatgaagttaaatagcaaaattcaagcacactagttctgactgtgcaccctctctcactcagaaaagcactttggaatgcgagagtactcttatattgacaacctttagttggttctaatttataaaaaaatataaaaatatttagacaatttggatattttatatctatgccacaacccattgtcaaatgattgagatatcattgtttggcaacaatgaaactgaaatcaactctaagagtaaagagtacgacttttaaagatatttggttaagagtaatgttgcaaggcagagaccaacattatagaagttctcaacctgtgtgctggatatagctaaaatttcccaggaccattgaaagaaattctcaaatccacaaccacctcaagtgttgtctgtgaatcaaaggagtgatgcattacccacaaacatgtagtagacattttttaagtgatgtagatgctactgcaattaataaatgcaaaattatattacaatattactgaattcagaataagttgattttgtcactatttttctcaatctacgcatgctagatataaagttattatatagagacgtaacatttttaatatttcagaagcatgctcatgatattgtaaaccaggcactgttaaaagatcactggattgggaattaataaacctgggatctagtcctcatttgatctcttgttggctatggtttgggggttttgggcaaactattcaaccttttctgccttggtttaattgataaatgatggtgttttcccagataaatcccttcccaacttaatattaccagatgtagcatctatggtttagaatgtacagtataaattaaccttcctgaagatcttcacaagttactataacctatattttcatggcactgaaaactaagtttttgatagcttacgtttttataaataatttacttactcatttttatcataataataaatctgattcactaatcaccaaaatatcatttttgaaaatagatgcatgaaaggatccgaacttgttatggttttatctgttcaagtcacctaattttggtagccacaggcccccattgtcaataggggaagattatccattttagcaatacagtctctgataacttcagcccatatgcccttcaattccacttttacgtcagattgaatgggaatgtgaggcccccagtagtaaactaaccctactttctctttggaaattggtctttctacctagctctttgcctctgttcacgttcttgtattccacagaaaatatatacattaggtgttaaaatcacaatgattaacaatttttaagtagaaatagttattaagtatagcataatcatgcctttgaattagtacaaaagtaggaaacagagctttagtgacttttttcattctttccaccatttacagggcaaaaatgaagaattttaccaattcaaaactatgcacatgtatagtttccaccagtatttagtagttatgtttctcaagatgtataattcctttcctttctgttttctgtagtttgataaaccctagataggagttaatgttgtttcagttaggtttattatttcttttatgtggtttaatttcatgcaataagctagagattttgtaacataacttgataaaaattttctcccttcgtatctttttgttttaaaataatggattaatatagattgtaattttacagtagaggaaatacattttacttttagttcttatctagatatcttaggaaaaaagaaacatcatttttaaggattattatttttctactaatgaaaaaaatagcatgattttccattctggactttgtaattaactttaccttggaataattgaatcttaaatataacttcattgaaaattttattttcaagtaacattttaaaatgcaaaatttgtgtgatctctactaaaaagaactctcacatcccaatgtgcttatagctacaataattggttaaaagagacaaattataaagaagatataggttgtgacattgaaattacaaaatgtggattagggaagtaagcgtgtagagttttgtatgcaatcaaagttaagttattaccagcttaaaaaacccttacgtaagatgtaaagaaaagcaaaaacctatagtagcaaaagcaaaaacctatagtagatatacaaaaggtaaaaagtaaggaatcaaagtatactactgagcaaaacagtcaaaccataaaagaagacaacaaaaaaaggcatatagaacaaaggatctacaaaacaattagaaaacaactttttaaatggcagtagtaaattcctacctatcaatatttactttgaatgtaaatggattaaattcaccagtctaaagatagagtggccaaatggattaaaacaacaagactcaactacatgctgcccataagagactcacgtcatcttttaggacacatgttgactgaaatagaagagatagaaaaagatattttggtttccatgcaaatggaaaccaaaagagaatggggatagccatacttctattagacaaaataggctttaaaaatcaaaaactaaaaagacacaaagaaggtcattaaataatgataaaaggatcaattcatcaagaaggtataacaattgtaaatatatatgcacccaacattggagtacctaaatatataaagcaaatataaagtgataaaaagaaagagacaaactacagtacaataatagtaggggacttctaccccaaattcaacaatagacagaaaatccacattaaaaaatcaataagaatgcattggactttatgctttagatcaaatagacctagcagacatatacagtacatctcatctaacagcaggagaatatacattcttatcaagtgcacaagaaacaattcttcagggtagatcatatgttaggccacaaaatgagtcctaacaaatttaacaagattgaaagcatgtattttatgtaaaacaacgccatcatggaaaaagtactagtgtaaacaaggtttaaatatgatttactgattgtttaaaaaggaattatcttagccctgatctgatgggatttcccctttgtaagcagcaaaaataagttcataatgaagcaactgtaataatacagcttcacagatctttctgaataaacagagttggatatgtttctacttcagaaaccatttactgtgggctcacagcttttccatacactctttacactcttaattttaaacccattcatcaaaaggattaagacaatgagattcaagtccaagacaataggaagtatgtgcatcaaaactgtcatgctaatgctctgaggaacattgttatttcaatagcataatttaaaaccactgaaaccatgttttatttatgattacctttcatacgttcaaaaagaatttgagatggtttggcagggatgtcttaaagaaacaaacaccaaatttttatttgttgtgcttctaacaagcaatttttcctacgtaagtgttacctgttttctccccttgattttgatctcttttgtatggttggtagttgtcgcacttctgggcatagtatggttttctacaagttaaataaaaacataaattgattttgatgtagctagttccactatttcagttagtgtgttttccatacctgcaattcataacatgtttactgacccagaacgttaaaactcaagtttagttcaatacagtcacttcaaaccaacttaagatagcagttacatttccaaggtcattatgaagacggagttcaagacttcagcagttgaatttgtcaagctcatgggtcttttagttacaggaagtgtgcatatttcacataagaaacagcaactctgatgatacattgaaactcaaatatacccaaggagtgtaaaactactttataagcccttaaacaataaatatgccaacaatcctctgcatactttttgtcattttttagagcattcaattgaattatataacatgtgataccaataaataattaactttttatttatttatttagagaatgattcttgctttgtctcccaggctggagtgcaatggcatgatctcagctcactgcaacctccacctcttagtttcaagtgattctcctgcctcagcctcccaagtagctgggattacagccatgcaccaccacgcctggctaattttgtacttttagtagagacagggtttcaccataatgatcaggctggccttgaactccggacctcaggtgttctaccacctcagcctcccaaagtgctggtattacaggcatgagccacagcgcctggcttataattaactttaaaaaatattctactatcgaatgcctgaaaaaatcatattacttctatgtattaaaaacaaactattacgtaaatagaccagagatacggtgtcagagatgagattccttggcaacagtctctgagacaaaaagttgcacacagaaagtattttgagaagtattgttgctatttataaggaagtgaaggaggcagtattgggcagagagaaaagctcatccacactgcagttgctactgaggcttcagcccatgtgacagggacactggagctgggatggtctttcagagttctaccaaattgaggcaaatgggcgagacttttgtatctttgcactagccaagagcaggcaccagggagaaatgcagctgtgatccttttgtagatattattattctggagtcaatgcaaccacaccacaaatactaggaataatattggtagtgtgggtgcatcgactccagaagaggatcttgatgaagcattacagtatccactacagagaggcactggcatattctgcttaccccacaaatattgcaatgaggatgcaagtaggagtagtgaggacataaaataaatcgattattttccactgggccttaatatatcagaaccattggaatttacaggatgatatttattatagtactcaaaaaaatctcttttaaatctccttaactcagaagggaattttaaaaagtccacaattcacctggtctatgaattcccttttaaaataaaatgtggtttaatcaaatttacaagaaaaaaacaaacaaccccatcaaaaagtgggggaaggatataaacagactcttctcaaaagaagacatttatgtggccaaaagacacatgaaaaaaagctcatcatcactggtcattagagaaatgcaaatcaaaaccgcaatgagataccatctcacatcagttagaaaggcgatcattaaaaagtcaggaaacaacagatgctggagaggatgtggagaaataggaacgcttttacactgttggtgggagtgtgaattacttcaaccattgtggaagaccgtgtggcgattcctcaaggatctacaaccagaaataccatttaactcagccatcccattactgggtatatacccaaaggattataaatcattctactgtaaagacacatgcacacgtacgtttgttgcagcactgtttacaatagcaaagacttggaaccaacccaaatgtccatcaataatagactggatacagaaaatgtggcacatatacaccatagaatactatgcagccataaaaaaggatgcgttcgtgtcctttgtaaggacatggatgaagctggaaaccatcattctcagcaaactaacacaggaacagaaaaccaaacaccgcatgttctcactcataagtgggagttgaacgatgagaacacatggagatgggggaggggaacatcacacaccagttgggggattggggggcagagggagggataacgttaggagaaatacctaatgtagatgaagggttgatgggtacagcaaaccaccatggcacgtgtatacctacgtagcaaacctgtacattctgcacatgtatcccagaacttaaagtataatttaaaaaatgtggttgaaaaacaaaacccacataatacaaactttgccagcttaactgttttatgtgtacaaaccagtagtgttaactatacatacattgttattcaacagatctctagaatgttttcatctctcaaatccgaaactccaaacccactgaagagctcccattgctccctgtaccccagcactggcaatatgaccactctactttctgtctctaaagagtttaactactttagatacatcatataaaaggaagcatgcagtatttgtcattttatgactggcttatttcacttagcataatgtcttcaaggtacacccatgttgtagcataggaaaggatttccttctttttttgtggccgagtaataatattccgttgtgtcctataccacattttttaatccgtttatcaatcaatggacattttagttacttcaatttttggctattgtgaattatgccgcagttaatatgagtgtgcaaatatctctttaagatcctgtttttaattcttttggatatacagatgctcattgatttacactgggattacatcccaatcagcccatcataagttgaaaatatcatgtcaaaaattaatttaatatgcctaagctaccaaacatcattgcttagtctagcatactttaaatgttatcagaacatgtagattacagtacatctgggcaaaatcatcttgcaacacagtacatagtagagtatcaattatttatcctcatgataaatatcatgctgcaacccaatatgtcagaagagagtatcatactgcatatttactagccctagaaaagatcaaaattcaaaatttgaagtatggtttcttaatgaatgcatatcgctttcacaccattgtaaagtccaaaaattacaagttagaccttagtaagttggggactaaccgtacacccagaaatgggattgctggattatatgataattctatttttattttttgaggactggattatatgataattctatttttatgttttgaggaacttccatacggttttccatagtggctacaccttttcacattcccaccaacaatgcagaagtgtttcagtttctccacatccttgccagcacatgttattttctgtttatgatcgtggtcatcctcatggttgtgaggtaatatctcattgtggttttcgttcttcatttgcatttccccgatgattgacgatgttgagtatgttttcagatgcttgttggctgtgtatatattttctttggagaaatgtctatttaaatccttgcccattttaaaatcaggttaattgtttttggtgaattccttattaattactcacctcagagcctttcttcttaaaatacagatttctcagaacctttcatctaatttactaaatgttgatcttgaagaagtattttaatttatctgaatttagtttcccgttctataaattgatagtaatcatgttttccctatccacaccagagtggtatgatgaggaaccaatgcagaaaatgactaaaaaggcatttttatgctgtccagatcttgtgcaaatatattataattgatttgaaccaaaagaatctacattttaagactatttaatattgtcgcatttacattgcactaatggttcctcttttttctcactgatgaagttctagattgaaactctgaggaaactgtaaatcacagttacataactctgttatattaatttatataacttctctgtctctctctaaatatatatatttagactatatatacatatgcatatatatatttagagagagaacgagattacacttaaggactctgcttagtacattgcaacttgcacctcattctaattgtgaaaacaacaacaaattttgattgagaccctgttatttttcagacctttggtcttgtgaggaaggaaaagatgattctgatacttatctcaaatagcttatcatctcctctggtggatgaggcttgtgagggcctgacacatggtagaggatcttattcattatataacaactttcaaaacacatcactaattatttttctgcttaaggtgaaaacgtagctctcccaaacaaataagagatttagactgaattctgtagaaaacactgcttacctcattttgcttagttttcactgcagagtcttgtctctaacattcaggtaggaggaactctattttaaaaaattgaataaacaaacccaaatcagaataaattatttaattcaggagttttttaaggtgctcagaattttggtagaatagcagtgtattttctgtaataagaactacacaatgttctctagctggttatactcaaatggttatatggattttattctgatatcagttttgcaattgatgaccacccttcatcaatagcgtggtctttattatggtttcatctggctttttcttcccttgtcttctgcactgggctgcctacttcttggctcttattattacatactctacttttttcatatacaaaggtcttagtgcattaatagtgagtttctgctaaaagtgttactttcttcaaatatcctgtcaaatgctggctgcctgatttattgacctcatagagtgactatgtgaatcttccattctctgtggaattccattccacattttaacttaaagactccgtcttttccagctgtgttctctctgctggataagcatttttcttttaatttctgtggtaatgggaagggaattttaaatcctgttttgcgtacaagtgtttaacaggtaaaaatggatgctgtgtcagctatctattgctgtgtaacaagctaccccaaatgtagagacttaaaataagaatcattttttttttttagctcatgattcttgattctgcttggggcttggttcatcgaggcgattcttttgctagactcagctgtgctcattcatgcactcgtggtcagctggtagttgatgaccacatgtggcattcatatgtctggtataactttttggttataagttgagacggtgtgggtgacaggatcacttgcctgtaattattcatcaggctagcatagttccatagcggtggaagagttccaagcatagcccaacacccaagcattgttaagcctctgcttatgtcatgtttgctgatacctcattagccgaaacaagtgacttgaccaatccatattcaaggagtggagaaacagactatggctcttaatgggagaatctggaatatctcttgacaaaagtgtagatgcaagaggagaatctgtggacatttactctccagcagagatgttgtcatttttgtcactaagacagttcctgtgtaatattatttattattccttggcagccataagtttgtggtttacttatggatacttcagtgcctgcccaatatcatgttggaaagagaagcccttaacaatttctcttaatttctacttctgaggaatgagaaaaaaaaaattggataggcataaatgatttccagcacaaattctaagcagctatttgagaggtgggtgggtagggagagatggaaaatccttttaattgagacatgctcaaccataagcaatttttctttcctcaggagacatttggtaatgtcaggagacatttttggttgtacatctaggagggagctctggccagagatactgacaagcaattctgatcctacaatgcacaggacagccactcacgacaaaaaattatctgggacaaaaatgtcaatagtgctgagattgagaaaccctgcttttcactgagcgcatgtagatgaattcatataatgttagttatagaagggcacttagatgatgccaactaaaacaggaaaaggcaatgattatttctctattcaagttagtgaaggaaggatatgtttaaagtcaggttggagatatttctcaagggtaatatttaagttgtgagtggatgccagatgcgcttgattgttacaatccatatttttatagctatatcaaatgatcttctctcccaaattaaaatggatattagatatatttcatggataccatatattataagctatagctcttagaagtatttgagtgattaataattcttgcatattgaatgagacatgtaagaaagatacctgatgtcctatgattcttagaaatatgtgcagtggttaagcacattgtcttggaaacatcacttgttaatgtgagatcctgaacaagtttcgttaccttggtaaaagggggatgataacatctaccctgaagatggtttggtaaaggtgaaataaaagagggtttatgaagaaccttgcctagcacataagaatcactgagtaaatgatgggggtgatggcagtgttggtggcaattatcttacttgtaagtagtagcaaatatttatttggattatatttttaatagcaagaaagaatctattaaaatgtaagcaaatagcaccattaagctttaaaaatccatagctcccaaacttaacatttttttttcttaaatccagaaatacaaatggttatcatgaatccttgagttccagtactccggccttgcctatgtagagtacaagcatttatttttctaaaatgagaattattgatgttaggtgtgtcatatattttatttactctttagagtgacagaaaagaaagcagacaaaaataagtgtttatgtgttcatagtgtttgtttctaattttccaacttgtatgtgcagactgtaaatatttagagggaagacatgaaattcttccttacctacacaatagattgtctttcttagaatctagacatgatttcaaattttcttcagaagttctcttgaattcttacggaattcattaatccaaatgccatcctttcaaatattcaaaaagaaaatattctccaatgttgcttacatggaggagagttattttatctactagtgagatggaagtcgctaacaatctttcttataccccatagtattaaatagtaatgcaatttgatcacatataacattgctctcctgttgacatggaatgataaggaggaagggaatatctaacagcactttttagatattctctcatagaattgttaatgtgagcccaataacttattttgtaagttgagtgatttttcaaatataaaagtgaagcaaacaaaaaaagttacccacattcattcaacaaagctagaaatagagtatgtgcttcttgctttcttatcaaccaaaggagacctgtgaattacaggaaaaccatgtgtgaatacttcaaaggaaatatgccaaacacattgtgtgtgtgttttaaaagatttagtagctcctttaaagctctaagtaaagctgttagtctgactaatcatgtacccctgaaaccaattaaattttcagactagagaagtgttcttcaaacacttgaaaaaaataagagttccttcctaaagccaacaccttttaattaacaaaatactcagagcaaagctgtggtttgcaatagtatattacacctactgttattcatgctaccattctggtgtgccaaactcaattcatttcaactattttgagcttgattttctgtctgcttaactatggagggaaaaccacaattttagtagagtcattttaattttctaatgaatgcatgagaaaggtattatgctacatagtatgtcctcagactattcagatgccctctctctctcttgctctgtctctgtctgtctctctttacacacacacacacacacacacacacacacacaatgtgtgtatctatctgtctacctagatatacagtttaattttgtacattgtaatacatctggttctggcataaggtgattgagcaaaaaacaaacaaacaaaacccacccaaatctgttactggaggaacctttaatagcataacatcagaaagactattttcagtaaggaccctaggcaggaaaagacaattcctccaatggacttgagaagaatacccttagtctctgaggtggttagagaggctgagatctgaaccagctaataccagagccagcttcttgtaacccaagataggggcataagaaacggggtgaatgcccaggcatgaacagacttggggttaagattaaatagggtacacgggaaaggatttccgccagctggaggggaagccatttcccatgctccttagggatgacaacaggagacccagcccagaacatcattgaaaattctatgtaataatttatatatcctaactctttacccgttcgttctagattatggattcaggcactcttagcaaaacaaatcctctttcagtcttttaaaatattgacttaacaggaaatatccttggcacaacaatacgaccctgcctgacccttagaactgtgaacaggttgctcagactgtacaaaaccactaacaaatctgaccagcctacacttcactgaaaaaggtgatttgcatatatttctagtactatgacatggtggaaaagaaagaaccgcatatgtgttagataaaggtaaacgcatctgaaagtgcagtaagaatcaatgtgatatatacaataaaataagataaataggccgggcatggtggctcatgcctgtaatcccagcactttgggaggccgaggcaggcagatcacgaggtcaggagatcgagaccatcctggccaacatggtgaaaccccgtctccactaaagtacaaaaaattagttgggcatggtggcaaatgcctgtagtcccagatactcaggaggctgaggcaggggaatcgcttgaacccgcgaggcagagattgcagtgagctgagatcacgccactgcactccagcctggcaacagagcaacactctgtctcaaaaaaaaaaaaaaaaaaaaaaaatttcaggacttcaaaacttctgtcctttgaaacactttgattaaaaaatgaaaaaaatatatacatgcctgaatccagaggcaagtctttttagaaaacataaaatattttaagtaatgtttttctgaacagaaatggctctaatgtgagaggtcgatgaagattagcctcttgcttctttatgttttaaagtatattccttgagacccaaagtttctgactttagaatccaactctcaactactatcagctatcctctagacactttcaaaatcctccaaaacctaatagtggtgcaagattttgtccttcctagtgataactagatttaagtaagaaaacgttaaagactaaaaagtgtttaggacccacaagaaaggtgtaattctgttcctcatggagatattttagttacacacttcttattctggtcctccccaaaacacagaaatctagagttgacatttaaagagaaaatgagatttttgtctggaaacaggagagaaaaagttttcaagaagtatagaaagcgtatgaaaggacacaggtttgaaatggcctgtgctcatgagagaatgcacaatagacatgggtgtggaggagcctggaaagaatggagagaggtaagtctggagggtcaaatctggttcagagtacagagcataaaatcccatacgaatgtagaacatgaggagccaataaccattgtgtgagaaatgcaggaaaaagaggaagaaaaaaatccacatagtgtacttacagtcagaacaatcctaggaggtgacttacatgtatgatgtcataaaatccgtaacacaattccattagattggtactgttttcatagttacacaggtgaaaacttttgagggtcaagatgttcattgtagcaggcatagtataattccttacctcaagatgcctccaatgtcagtgaacattacttttccaagattgtctatttaggaaaaagtaaggccagttgtctatgaaggaagtactattataatcgccactttacagaggagtaaatggagattcagagaggttaagtcatctgactatagttacacagctaaaaaaaaaaaaaattatagagcaaggattcaaatacaacaatctggtcctagaaagcctaaatattctacaccctgctttctgattcagagctatttcctgcttttctcccttcgataggaaaaaaaatgtatgtgtgtggggttgggggcaaataaattgactggctgtattttctctctttaatatttgatctttcattgtctgctccaagcagtgggtcttcctccattatcttctcgtgaaaatagctaaaatcacctaactagtaaaaacctaggcatgttttgtgttctagcctccattcttccattctaatgggtggctgttaaattttagtactcattgtatgtagaagacctctaagttcactaaagagcttactgcacattgacttttctttagattcaaagggaatcaattgagcacctcctatactccaggacatgtgcaagatgcaagagatagagcagtgagaaagtctgataaggtttcccctccctttcccagcagtgtacagatagatgttcttcaggtggtgcatgctggagaagagaagaccagaaatactggcctgacgggtctatagatgagattatctgcccatgactggcgcagggatggccgcattgctagacctctccatcatcctctgaatatgcttcagctaatttatcatcccaatggcatatttagtcatcatgaaccattctctctttttgagtctcaggccctggccttgcttttcaatagacttccaatagattccttcctccttccttcccttactgcctggcttcctgacttccttccttcctgccttcctgccttgtcttgccttgcttttcaatagattccctccctccctccctccctccttcctccctccctccctccctgactttcttctttccttcttcctttctgtctttttccaaacgtgcttttcaggaaacagtggtctgcttgttgaagtctgataattctctagttcctcatccttcactttattgaaatttagtgtgacatgatcatttccacctcattaggtacttctttcatggtcagaagtaagtctggagaaaaaaaaaaaatctcttgtctctgctcttatttgagggtcaaattttcaataagtcactttttaaaaaagcattttctgacacttcccataagcttgaaatcctcctaaattgctgtatattgcctcagtataccttgtgtatctattttaggaacactccatccacatttgccagtcagcctggtgttctgcagttagttcctacagtgatattttaatttagctctcttttcatcctcacacatgcatcctctctggatatttagctcctttcctggaatcccttttaagatttctagatctttttgcttccatgatttcttctcctggactgtgacacaaaatgctatttcttctttacattacatttaattctttctagaaagagcctcagagtagtcagatagctttgagaaacaaaactttttctttattgcctcactgttactgcctttcaatcattgtttcgtgacacaaatttttttattctctctgacaattaaaacactatttttttctgtctgcattgatcaaaattagttccttcattcatagaaaactcttggtgtccctgagaagcttgagagacaagaaacattcttccattctactcatcttcttctctaatgaggagacaaccttaaaagcacagttacatagccataaaaattaatgattggctacctcagaatgaaaattcaatgtctcatttttttttaatattcttagaatcgttcactggttgtccagtgtgagtctcctgttgagatgtcttttgcagctttccttgaaacctttcattccaaactacatagtccaataattttgccaccaatcttctggttatattatgctcttgagtctgttgtctataaacttgattaggcattccttcccctcaccactcacctctgataacccagctgtgtgttggtatttagtatcaattcacaccagcaagttcagccctcttcaatcaatatagggccacacacggacttttgactgactactccccaagtatttcacattttggggccttatctccagtttctcaccacagttgttcatcactgtgtttcttactagccaggcgtttataaaaacagtaatacctaacactattgatcacctactatagtgtcaggcgctgtaataatattattgtgatgatgatgattatgctgctctttctggcattgtcatacgtgtattgcttgtactactcactgaatctacacaactgcccttatgacatttaccctgttattattcctcttttaaggtaaatacatgaaaaatgcttcccactttgccttgcttactgcttattgctagtactgaacaaatgttagaactgaaacttagagaggttatgtggctttaccaaggtcccagagttcctagggcagagaacaggattgtctaccagacattttaattctagtactatgcatcttaaccattaccataggctgacttactctacagtgtccaacactattcatattaagatttatttaatgactttgaaacagtatttcatgtctaaatagaaaaactactaactcgcatttttaagaaaatattgtatcttggtttttcttcactgctggccagtttactaacaatctgaaataaaaagaaaaaaatatgataaactgctcccagtataaaatacagagctaagacaagaacgtttcattggctttgatttccctagggtccagcttcaaattaatttacttcctattcaagggaattttaaatcagaaagaagatcttatcccatcttgttttgcctttgttttttcttgaataaaaaaaaaataagtaaaatttatttccctggcaaggtctgaaaacttttgttttctttaccacttccacaatgtatatgattgttactgagaaggcttatttaacttaagttacttgtccaggcatgagaatgagcaaaatcgttttttaaaaaattgttaaatgtatattaatgaaaaggttgaatcttttcattttctaccatgtattgctaaacaaagtatccacattgttagaaaaagatatataatgtcatgaataagagtttggctcaaattgttactcttcaattaaatttgacttattgttattgaaattggctctttagcttgtgtttctaatttttctttttcttcttttttcctttttgcaaaaacccaaaatattttagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggtatgagaaaaaatgataaaagttggcagaagtttttctttaaaatgaagattttccaccaatcactttactctcctagaccatttcccaccagttcttaggcaactgtttctctctcagcaaacacattactctcactattcagcctaagtataatcaaggatataaattaatgcaaataacaaaagtagccatacattaaaaaggaaatatacaaaaaaaaaaaaaaaaaaaagcagaaaccttacaagaatagttgtctcagttaaatttactaaacaacctggtattttaaaaatctattttataccaaataagtcactcaactgagctatttacatttaaactgtttgttttggcactacgcagcccaacatattgcagaatcaaatataatagtctgggaattgattattatccactcttctaagttgtctgtgccaatttgccttctccaatgataaggataattgaaagagagctataacttaaaaagagaaaagtaacaaaacataagatatttaaaattaccctagatcttaaagttggcatttatgcaatgccatgttcaaatgaacatgtttttaatacaaatagtgcatttttcagcctcagtgtaatccatttggtaaaattatgacatcaactagaaacattagaatacattgatgtaaatatggtttacctagctagatcaaatatactatatatcttttatatttgtgaatgattaagaaaaataatgttggaattgttatacattaaagttttttcacttgtaacagctttcaagcctttctaaagaaatacaaagttgtgctgaaggtatttaggtattaaagtactaccttttgaaaaaacaagaagtgaggcagacagagtaaggggaatttctttgtaaaataaacttcaccaattccataggaataaaagtaatttgatagtaaacaacctgcatttaaaggccttgagcttgaatacagaagacctgaattcagtgccatttgcaaatgatgattgtggtcaagccatctctggatcttcgtttcctattctgagtacagagcatacagagtacacattcacattcacaatatagttatggatatggatgtatataaatatatgtaaatactacatatatgtacctaaaatttgttttacttctgctttaaaaaaagtaattatagccacatttttcagaaaaagtaactgaggctcatagatgtcaaattcccagtaagtagcagaacaaggattcaaatccaagtccatttgattcctaagcttgtgttattacttgctactgcagagagtatacgtagcaagtaatatatgtactgcaagcaatacatactattgctgcggtaataactgtaactgcagttactatttagtgatttgtatgtagatgtagatgtagtctatgtcagacactatgctgagcattttatggttgctatgtactgatacatacagaaacaagaggtacgttcttttacaataccatattgagttatataatactcccaggacttttatttaccaaaggaaacaatattttataatgtttaaagcccaggttttgaagttacattgtctgggttcaaagcttggctcccaagctgtgtgaccttgagtaagttattctgcctacctgagcccaagtttatctagctataaaatggggatagttgtactatctgccttgcagtttgtcatcaggattaagttggttggtacatgaaaaatgcttcccactttgccttgcttactgcttactgctagtattgaacaaatgttagtaattatatttggttccaccacgaactctagaaatctaaccaatgatggcatttgtattatgcaaactgtatatcacatcataatattatatggaaatgagagcttgtttccgcttctgtagcctagtctaccattgacatagcttcctgcagaagttaccagataatagattgggagagaaagtccacacttccttgtgacgggtttgtgagtccagcatttagggaagccattgatgtgctcagtagtctccagagttctctaaataaatgtgtccttttcagaaaggactactgatttgatgccccctcacagagatcgtctttaaatataggtcaaaaactaatgtagagggccaggtgcaatgtttcacgcctgcactcccagcgctttgggaggctgaggcaggtggatcacttgaggtcaggagtttgagaccagcctggtcaacatggccaaaccccatctctactgaaaataaaaaaattagctggtgtggtggcccatgcctataatcccagctactagggaggctgaggcaggagaatcacttgaatcctggaccagaggttccattgagctgagatcacaccattgcactccagactgagtgacagagtgagactccatctcagaaaaaaaaaaatttagggggaaaaatcaaaagccatttctgagacacaaaaatacaggatttataaattatatatggtatatataaaaatatttttaaaatagtatatatagcatattatatataatgatatgtaatgttcatatattacatatttataaaaaaatctaatctcccttctcttgcttgctgaatagggggatgctttgcctgcctcttcctcttatattaaaaaataattcttaaagacattgtcagttcttggcttttatagcctcaatcaccaaattgtcggtaaaatggccctaaataatcattaaacaaatgtgtgtgagaggggaaataagaaggataagtaagtatggggaggattttgttataatttcaggaaatcaatatcaattttatgtaaagttttaaataaagcaatcccaactttaatgtttgatgtgtgaaaaattaggcaaaattccaaaagggctttataaactgaaaaaaactttactaacacctatccatttttattattttaaccaacttctattgagctgccactaagtacctgggaaacataaagttgtacaacatagaatgtgcaggtaaaagaggttgaaggaagaaaataataacactatgatagagataaattttaggataatagctaacacatatgatatgccagtcattgatctaagtacttcacgtgaattctttaatgcttacaacattactgtgaggtagatagagaggcacagtaaggataataacctgcctgagatcgaggaagaaagacaatgatgagatgtgaactcaggcagtttggttccagagtcctctcccttaaacctcatagttttcaacttctctgatattgtgtgggtgatgctgttggggctttcttcagggaaaactaagccaggagagagaatggatgctagtgagatattcctgaagaaggaaaaacttaagccaggcattaaagaatgagttggaattacctagctagataaaacgagaagggcaatccaggcagagggaacagactgtgcttttcactgaggtggaaaaaaaacagagtatatcagaggaattgtgattccatatggctgaagttaagggtatatgatgaggaagaaattgatgaggttgaatagagaggactggggctaaataatgggaatcctttgttgccagactgaggaattttgatgatggcctacaggcagtggcaactctgaaaggattgtaaacaggaaaataaaatcatcacatatagtttagttgcctatcaattagagctctctggatgcaagcaacagaaatcattctctgattaaatcaggcagaaagtaaatgtgctgtaattagcacaaaggcattggaacaaaacttacaaaaggaaaaagaatctgagcatgcctttctgggcatgtggctagcaagaagtattccagtctgtttgtgatactctcttttctccatcctgtgtgtaactctgttcaaattttaaagtcttaaaagagagtccagttcaccttgtttgggtcacatgttaatacatgagctagaagggagcagaaaactttgatttaaatccctctcctcccaaagtctcaaaattagggaaaggcaattctcctgaatagaaactgggttctattgacaatagaagaaggaaatgattctgaccaaccactaaacaataattgtccactgaactcagtcaagaacatgtagaataagttggaggatagagcaaataaaggagatttgtaggaggtaattattatgatctaaagcaagcttgttcaactcatggcctgtgagccacatgcgtcccaggatggctttgaatgtggcccaacacaaatttgtaaactttcttaaaacatgagatactttttgtgacttttttttgctcatcagctatcattagtgttagtgtattttatgtgtggcccaggacaattcttcttccagtgtggcccagggaagccaaaagattggatacagctgatctaaagcaacaggttcatctactcaacttcacaacgtgtagacctgaaataaagaccattcatataccaatacctgaaatataaatttgtttgaccatgacacgtacagtaattggttctcaataaatgtggatagcttgatggataatgtgaatgcaatgtgataaggaaacttcatattcaacaaagactggaatgtgaggattataattccaaagcaccagaagatagataagataatgcaatgagacattttatgactcaaggcaaagttagttatgagattcagaccaaaccttagacgtgcagtaattgaaatatttgccacagaaggggtataaggacatgacattcaagtaagctaacctttcactagctttagactttgaactcagaaaacatatttggtgaaaagcttatggtcccctttagtatgtattgcttgattaaagtattattttagaaaatggtgagctgcttccattttgaaataaaaataatttttactaagtgaattatattcagtgaaaaaaatggaagctacaattacaactttaatttttttaagttttaagaatacagccatttaaaaaaattaagcaaatctgcttcattttagacagtagaaaatataccattatcttttagaagaatagagatgtgaaatatgcaaattaagcctttagaagtaaagcacacatgaagttcaaagtttaatttctagaattgtgaatcaatagcagtggatgatttgtactttatagcttagtgtcggagaaatctgattaaaaaatgctttttctgtttcatcacataaacataagtaaaattgctctgaaacaacaatatttgacaagaattagcagttttcttttttgacataatctatcaaatgaagggaaaaatatgtcctgggttttgctttgagagtgattactaaatctgacccttaaggaaaggaaggagagaacaaagaagggaggaaagaaagggaaggaaggaggaggaaagggaaaaaaagaaggaagagaggaaggaaagcaggaaaaaggggaaggagagagaaaagacaaaagaaaggtagcaaggaaagaaaaaaagacaagaaaggaatattaaagaggacaaaagaggagtgaggaaaggaggaaatggaagagggatggtgggagacaggagggagaaaggtggagggggaaatatgaagagaggttcccagcagtggagactagtgttgctatcaacaaatagaatttagatggccatatgatattatttttcataatactggtgtctgattgcctgtgctgagttaattgtagtcttttttttcaattccgtttggccaggtgttcaggataattcaccacaaaatctcaaccactgcacttgtattgaataaagaattgagttggcaaaggcattttatcctccagtaagacctttccagattggggttgagacaaattggccaatctggacaagatgataatagcattgttcaagattaatttttaaccacacattgcactgttacctgggagatttcattatctaaaaattgaatgagcagttttagtgggtatagtgtatatttaaatgggacataattacttgaatgagtttaatttttgttgttgttgttaaggtcaaagtacttaaaaattatgattttttaaaactctgtctatacacaaaaagcatttgaattagctacagaataattctgattataacttttggtgaatagattcagtcaaaatctgattactaaacaacttgtgtagtatagccctggaagaattgatgggacaatgtgtgggtaaagtggcattggctatttaaactaaaagcaatacaaaacagaatgtttcttggttttattctgttgtcacaaacccagcagaaagtggctattacaatagtttcccttattcaacaaatgagagaagttatagacaatttagttaattgatctaaagtcacttagtaaatgtaattgtcctaacataaacccagacccccagacctcttgggaatagataatgtttcttacttcttttctatttcctcagccacccccctcaacttcttacacatctcatttctccatccaaattataacaaaacaaagcaaacatggtttatttccatgggcatcaaatggatttcacgaggttgggtgacagtcatcttagggtgaggagattgattattctgtttttctctttcatcgatcaacaatccagcccttctcatctcatcatttcatttctgcacaaacttgtttaagaaataccaattaagaaattaattaagaaattaatgttgtaatctgtttggctgaagatatttacaaattttgtgctttaattatcttccaacaaatgtacatgtctctggtagacagcttgcgaccatctggatgactgatccatatttatataattttctttctttacctaatgagaccaaatccactattatcttcaacgaaggatgtaaagatatgtcagtgtcagtaatgtgacttattttatattctctggtcataacaaaaataaaccgccccttaaataaaaaggtcatagagttgcaaacacacacacacacacacacacacacacaaaatcatattttctaagtctcctaattacctttttatggaaaatgataccatatgcttttttcttaaagaaactacataaacttataaactatactaaactacacatttcaaagtctatgaatggaaatgtgtatcttattatattttaattcaattcactgtaaacttttctgtcaaaatcttatcaagcaaaactgatccaggatatttacatgaattctgatggaagtcactgtactgtgttttccataaaataccagtgggattctgataaggaagtttatgtttgccattgtgtttaaatagagaattctgggccgggcatggtagctcacgcctgtaatcccagcactttgggaggctgaggcgggtgtatcacctgaggtcaggagtttgagaccagcctgaccaacatggagaaaccccgtctctactaaaaatacaaaattagccgggcgtggtggcgcatgcctgtagccccagctactcctgaggctgaggcaggagaatcgcttgaacccgggaggcagatgttgcagtgagccgagatcacaccattgcactccagcctgggcaacaagagcgaaactccgtctcaaataaataaataattagagaattctatttacaaatttcctttcttggatctagttagggctcctttatatggagtgatttttattgttttcatagaaatacgtagaatctgggtcttctctaactttcttacaggaaagcaatgtaataaggtttttttttaattttctgaaagttatataatgttattgttccctaaagtttaggacctgccttttaggctttccatttcaccataacttttggtccttaaagtctgtaattgaagttacagtgtgttatgatgtaaatttttcttattattacctttaatgttagggtaatgttaactaatgttaatgttaggtatatggttgtttttttcattccttcgttcaacaaattgtctttgaaacccatgttacaaagcactctagagtcaggttgaagactattaagaaaggagaatagaaagagacactagagtaataatttggatttaaatttgatttccttgtgtatgatagtgaataagtgtgaataagatgaggcagtgatcacacatcactattagtaaaagtgtttctgtacctgtatccacacttttatgtatatggttacttatgttaaagtgatacatattatataaaattaacgtatacattaagtagatattttaatagtctgtaattaaatactactagtattttctttcctccttcaagtgcttacttttgatacctcgagttacagtgtcataaagattctttagaaatatattgactgtcttttaagagcttttgatacaatactgagtttacattcatctgttatttattgaacacttgctggtgaaaggcatcagtgttatctgctcttagggaacaaaaattaaaaagggataggccctaattttagagtgtatcctctataagaaaaacataaaagatagggcagtcatggccacaaaagaaaaaagtgttatggtggtttcaatcatatatgtattagaatgaataaatcaactgatcaattgtgatttcttattctaaatatgtgcctgcctttttcatatagatgaaaattaagctatgtttatctttccagggatcttgttgatttttattcaataacttgggagtgaaagttgatttttgcatatgttttaatgtttttaaatttcataaatgaattgatcagtaatttccaaggtagtaatggctgcattgtttttgaaaaaaaaaaagcaacaggatttgattgtgcttttatgatttttaaagaattcattaaaaataatgccacggtttctaaaatgatttgagtcaatttcttattcgatttataaaaataactttgaatacaattttagtaattcacaaatgctttcagttcccttacctttatattttatattctgtgtaaacaagtgacataatatttaagaattatatatctcctatgatttattcaagaaaagaatatatactgtattatttatttcaagaacagaaatgctttgatttaactgtcatcttctctcttcaattatggaagcaaaataaactgtaatgaccaatgtaacccctcccccatatcaagttaatctatgttcaactccagaattatttttgaacactcaaactagaaattaaaaaaaattaaatccatgaagacgatttttgccaaaagcatatagataaattgagttgattctatacttaagaaagtggagaggagagagtaatttggagagagtaatttactcttaatcccatattttttccctaaatgtgaaagaagtagattgtagtgagagggaaaataacctgtagcaacttcattgaggctaagctttctgtcatgttatattatacgaaagtaatgaaatgcttccacagatagaatcagaagtcccctctgagaaattctacataaaaattagcctgccactttaccacacttactcaagtttgatttttttaagttatgtaatagatgttaggcactagaagaggacatttactgggggcaaagatcagtagttggaaagaatgcaagcaggcaagaagctatatataatgagattttacagtacaattgttttctaaatgaaaatgaggacgggtccagacacaatggctcacacttgtaatatcagtgccaggatggaggatcccttgaggccagaagttcaagagcaacctgggcaacagagtgagacttcatctctacaaaaaaatgaaataaaaagttagctggctgtgatggtgtgggcttgtagccttagctactcaggaggctgaggtgacatgatctcttgggcccaggagttcgaggctgcagtgagctatgatagcgccactggattccaacctgggcaatggaacaaaactccatttctaaaaaagaataaaatataaaactaaaataataaataaataaaaatgaggatatattttattttaacatttggaaactttgtaggtgaggaccatgcaaacattcaaggtgtgagttctgaccaaatccaattattaaccataccaatgacttaaggtttcttcacactccttaaagttgattaatataatgattatatagttgactggtatgtcacagcttgaagcctttgagatttattcctgccttttctgtaaaggttgttttgttaattccagtatgtactggtcgtttttgttttgttttgtttttgtttttgttttgtttttttgagatggagtctcgcactgttgcccgggctggagtgcagtggcacgatctcggctcactgcaacctccgccacctaggttcaagcgattctcctgcttcagcctcctgagtagctgggattacaggcactcaccaccacacccggctaattttttttatttttagtagagatggggtttcactatggtggccaggctggtctcaaatacctgacctcatgatccacctgccttggcctcccaaagtgcggggattacaggcgtgagccaccgtgcccggctgccaatatgtattggtctttttcatcaatgattcagtccaaaatcattttgtcctttaactatatattttcttgtaaagctgcttctgttgtcttgaacttttcttttcaaatgtatgttgtcatttgactttttagattgttattttctggtcctcgaaataaatttaaatttcctgtaaaggaaggtgtaatattctatttgacatagccgctaaagatgtactaggtgctttataaatattgttgatttactttatcttcacagattactagttttacttagtatttggaatatgacaacattttatagagctatattcatatatatgtttatcttaactgttaaatgcaatatgattcatgtcttgttttggtcaatgatgaatgaaagtctcctgagaattaaatttactgcatcgatgcaaaaacaatcataattttagacactctaagaattttagaaattaaaggattttttttttccagtttactctgttaagattgtgtttagctatgcgtgacagcattctcactacagtggcttatccagatagtttctttttctcatagagcaagacttccagaattatgtgttccagggtcagtgcagcacctccaaaaccgtatgtcccaactttttcctccaaccccagtcatctccaacatgagactttctttttgttttgttttgttgtttttgtttttgtttttgttttgagatggagtctctgtcgccaggctggagtgcagtggcgcgatctcgactcactgcaacctctgactccctggttcaagggattctcctgcctcagcctcctgagtagctgggattacgggaacgcaccaccacgcccagctaatttttgtatttttagtagagacggggtttcaccatgttggccaggatggtctcgatctcctgacctcatgatctgcctgcctcagcctcccaaagtggtgggattacaggcgtgagccaccgtgcccagcaagactttttttcctgtggtctcaacatggctactctgcctccaggcactatgtctgtactttaaaatggaagaagggaaaatggggaaagtaaaagcatattccagctgtgtcagctcctgtttgtaaggaaaaccagtgcttttctggcagccccacacagaagagtttctacttgaacagtgcattaaccagaaatgtgtcacgtgaccattcctaacttctaaggatcttgggaggattgagtgttttaactgaataggtgtgtttctttcttcataattcaaaatgtgaaaattggtaacttagttataaaaccttgctagtctgaacagaatttggatttttttagctaagaaggaaagaaagggtatcggataggcagctggctatgctagccaagatactcttaataatgcacatttttcttctttggacataagcagttttaacttagctaaatatgatgtgattgttttcctgtcttcttagttctgtttaaatttgtttcagaaatcaaggaaataaaatggagaaaaaactctattattcatgtctatctttctgcctctgaatatttttatgttggagaaagagaaagcagtaactttcataatagcttacatagtctgacaaattctaaacatgtccgttagcatcaatatacgtggtattaggtcatcagtttttatattctgaattattaagacccaaataaacccactgagttcaagagaaagtatacactgagcaataaaaacattaccagttctagcaatgataatcaaacaagaaaacaagtaatatagtctgtttagaataacatgttttaaagatcaagtttttcttccttaccaatgttgcctttcttgtaacacttttttttccttcttgagataggctttcctatcttttgtcacaaaccccaatatttacatggccattcgtagtctattcatagcagcaccaccccatggcccaaacttgtagatattgccctccttctatggttgttctaataagaataaccactcttgtctctcataatctcagctgttttgtgccgttaaaatggaaaataatgagtattaagatactaactaggggccaggcgcggtggctcacgcctgtaatcccagcactttgggaggatgaggcgggcggatcacgaggtcagaagattgagaccatcctggctaacacggtgaaaccacgtctctactaaaaatacaaaaaattagccaggcgtggtggtgggtgcctgtggtcccagctactcgggaggctactgcactccagcctgggcgacagagcaagactccatctcaaaaaaaaaaaaaaaaaaaatactaactaggtttcagtcatatgagatgaataagtcctacaaatctgtacagcctagggcttgtagttaacaatgttttatatttaaaactttgctaagagagtaaatctttttttacctgttattatcgtacatgcaaaaataatagtaaataaggaaggtaagagaaaaattttggaggtgatgcataggtttatggcatagattctggacatgatttcacaggggtatacagtcatgcattgctcaacaacagatatacattcggagaaatgcatggttagctgattgatcttgttgtgcaaacatcatacagtgtacttacacaaacctagatggtacatcctactatacatctaggttgtatggtatagcctattgctcctaggctataaaccagtacagcatgtgactgtactgaatacttcaggcaattggaacacgatggcaagtatttgtgtatctaatcacatctaaacatagaaaagttacagaaaaatattataatcttataggaccactgtcctacatgtatacagactgtgcacatgatagtggtccattgatcaaaatgtccttatgcagcacataactgtaattatctcgaaactcatcaagctgtgttcattaaatgtgtatagctttttatgtcaataaagtggttaagaaatcaataaagtggttaaaaaatattttgactaggaaatatactatcatttctagttgataaaagatctcaacatttccaaaattgtcctacagaaaaccaggttcatcaggtgttcatacatgatcctcatgaaaaggtcaaataagctgaaaaacatgcatagacgttgcctatcctagcaatctatgatgtacatctccatagtaaggtcactgaaaagtcttttaggaatgttagtattgttagctcagtatttctcagtgatttctccatggaaaccatttgtgtagagcatcttgaggagcacagctgagagaacattatcttagttggatgtgtatgtccctctgagtcacttgatttctctacatatgcttttaccaaattaatcttttagaaatcttttctcttcgcactatgtctataatttgtgaagttgttaccaggataacatttgtgcctctcaccatgatgtacctaccagggtccaagcagccattccttctctagagcaactgtctgagggaaagaatttaacacagcattctacgaaatcattttatttataaaaatagattactgctttacatatagtaatttatatttagaatattgattaattattaaaatctgcatgagagctttaaagagtagtacataatatatagcagtttgtactcaaactgtcttctaaaaaggattcactttttgtttgtattctattgtcctattcgttgatagtgttacgtaagtaattataaaacttaaaatctggaaagagaatgtggactcagaatgccatctcttttgttatttcaaatggattagaaatgaacatacatattcattttctttcattacacatccagagaaatagaatggattttataaatatgtaaaagcaaggattttgatcactgataaaaagggaaggtttggtcactaccttatttcattccttttttcttatccttttttttttttttgtcaattatttgatgacatctctgaacatcaccttttattcatgacaagaattgggtatcatggtaaagaacactgttaatataattcagttacttcaccccctcctgaaatatagagaagctttaagactatgtgaatatttttttctggttttcttgtatttgtagaaatagcatgagctttgtttaaagtcaggcatctaaaaccttgccctgtatgttattgacaacctgcacaaattttaggatctattctattacagtttgttcaactgtaaaactaggatagcaaactctatgtcatattttcgttatcagaatttaaaaagcatgttttaagatcttagtaaataataaatctctactctgtagttgaatttgttctatattctttaagaaattccctttgatggttatgccaacctctgtattacttttcttcacactttaactttgcgctgaaatcatagtagtattttacgttatcagtcaaaataacagtcatccttaaaacaaatatgaattttagatgattaaatagatttgtatggaggttcttcttgctaatcatagcagttatccttggtgaaaaatgatagacacttgaaaaaaccaattaatcatgatggctatttttgcatcataaataaagctttcaaatttgagagggaatcaaaagggcaatggtagtatagtgtctcaaagcccctttccaattgatggtacaaatttaaaaagagagagagagagagaaacatgtttcactgtaattgttttctaagagcttccaaaaaagcgtattttcttaatagattcaaatttttcagttggattgaaagggaagtcttggagtgtagtgaggagggcaccttctgttgagaggtgttcagacgacagagtgtgcccaaggccaaagatgagatggttttgcgaaagtcagtggccacaaacaggtgtgtttgacccctgagagatatgcaggaagtctaccccactttaattcttccaaatattctttaccttaattcccaagtacttgataaaggagcaatggggagaaaatatgcacactattatggaaaagttttgacctacactttggagagttttagattaagagcattctagaaatcagtcccaaatgcctagggtttacttacttaaagataatatcatagtttgggtgactgggaagcataccctgagattgaggtgagcatgcagtatgtctatttaggagtgttcttggggtcaacgtgtaggggcagagggagaagttgagctctgacgcagtcttagtaagggcctcagctgaccgttcagggagttcttaagctggaatgacccttcagaagtgctaggaaacgaagaaaggggactggatctttataaccccgtgtcaagtcatgcactggatgtgggctactccaggaaggcaacgaactttagcaagatgattctctttagccacgggaatttccataagggggctgctatggtctgaatgtttttgtccctccaaaatgtgtatgttgaaacctaacactcaaggtgatggtattagaaggtgggggtttgggggggtgattaggtcatgcgggctctgccttcagaaacaggatcagtgcccttataaaagcggctccagaaagcttccttgccctcccaccatgtaaggacacaccgaagatgccatttaacaggagtgggccctcaccagacaatgaatctgctgatgtcttgatcttggaattcccagcctccagaactataagcaataaattctgttgtttataaattacccagtctaaggtatttagctatagcggcccagactaagacaagggctgacagctgaaggctgtctaccagcagcactcctagcagctggggaactaagtccttcatttccaaaggggaatctaggcagcatatttacagcttttcactacagataagctcattatttcaaatagggactagcaggaaaaaattaaattgcccaaaatttagtgggatgctgaaatagattgtggtgtgtaaattggagtatagtgaggagagcaccttcaaaccagtatgtactacatgatattgtttttgttgcaatatttattatatacccaaacacacatatattacttttagaaacacacaccacatatatatctatgaatattttatatacacatagggaaggattgttgatgttatttatgctattttaaagatcgatgttttcatataattatgtattggttatatattatttcttgatataaggtaaaaaaaaaaagcaaaacaaactttaagtgatcactatgaaaagaatcccaatgctgcacatttaggtttatccaactcttcccattaaaatattaaatagtagaaataattgtgaataagaaagagcagattttgaaaaatggaaagaaatgcttaaagacatagcattgttgcccaaccatcattatttaaacatacagtgtttggctttgaccaaattgccttcaaacacttccttttggcccaaaatgttaggtcatatatactaccataaaattcatgatgcttaccatgcattaatttctagtatataccaggcattgtgctatgcatatcatattcaatatttctaatcctctcaaaagtggtacaagctaactggcgtttttcttgttttgaaagggagaaactcagagaggttaagtgacttgcccaaggcaatgccattgataagtgccagattctatcacaggtttattggcaacaaaccatatgtgcgcgtgcatgcgcgtgtgtgtgtgtgtgtgtgtgtgtgtacacatacacgaataacatatatggtataaatacgtggaaacataataaactgcattgagctgcgtttataattagtatttaggacatgtttggcaaataaaaacagtggagattgaaatggatttgcttaggaaaaatgatacattaaaataggctttattatgagtcttcaactattctgtgaaaatagatacccagggaagaaataatagagaatatgaatcttgagcaggcaactgagaacttgtcgaagagccaagataaaaatgtcagagaggagaatattttggcagctcagatgagcccccagagggtgggaggcaatgatctcaccgcagtctcgtatctgaaccccaggtttttgcatctccataaagtaatttcttacacccctcaataatgatcgggcttactctcaatctctcgctctctctctgtgtctctctcacgcacacaaacatgcagaacatttcttgcacatgcataactcataagacgattatgtaaataccagcctttttatttcataactaaattacaaggcctggttattgtttggactgtgaaaaaataattatgtgaataggtgcctcaagatgaaagacaaggcaagattgtgaaattattcatatgatagtaatagtatgcaaaaaataacacaatctttaaagatctttaacgacctagttataaaaccatgctttataacaaatataaccatgaggaaataaaaagaaaaatgtaataatatactccaagaataaagtcaaatgtattgttgaatgtaaggagttggttacacttccttatagtggaggttattttaaaatttgtggcttacgtggtgttatgaattgccctagatcaacactattatgcaaggccaactattaggttatttttggtagataaccacagcaaaactttagtataataggtaaaggttagctacactcccataccctcactctcaggtgttgtcatactccgtataaaaggttcaatcaagggagacatgagaatattccagaatctagaggcaggatgcagttaaccttagagaaggcatcagacaactagaatcttcggattcaatgtggaaacaaagcatagtttaggcattaaatcttgggcaccattccaaagaatacaggttccataacttactatatttttatacctagcaagctagagatgaggaattgctctcaaatattttaaccaaagcatgtatcttaagtaacactaatctcataagtgaaaactcatttctaatattcattttgctcattagcaaggcctctagtgttgactgtgataaaaaatagttcaaatgctggtagaacccaccccaggagactggcctttctgattaaattctaactctatccccacgtgaattcctgacttaagtaactgagttcctgcacatcagaatataagtatattatagatataaaaacatatgtaattaataaatattttaagtgagacacttctttcatctttatggcttaactatatcagacatttgattatttttagcggtctaactacaaaacaaaacacaaagcccacaactaaaaatttctttgtatatattgcaaagaggcaaccatttggtgtcaattcaatcatgagtgaaatgctattatacgagtacatctccctggcttgtatgggggtaatagggcatggaatttacagattcacaataactgagatattcacaataacaaagatatcaatatgtagcttttcccataactttgtgtaatgaaatcctcagtttgtgctgtgtaaaaagcttattgtttacttctcatgaaaatcatcttagtttttatctttatttaatagtctgtaatttgggggtaatacattcgttttgttgatactatgtgaagtggcaagcagaaaattctaacaggaatagataagcaagtatcctataaatcagagtcagtgtctctctctctctcttttaatgagtcagtctgtctctctctctttttccctgcctggctatctatctgtatttttcagttttgctttgcaaataagagaattgtgtgttgtaaaccaaccaacttaccattaattttctctgaattcaaaagcaattacaagcggactcttgagtttgtgctgcctggttgtctgcatataggccagatgtctagaataggatctttatttactatttttaccctcctaatttcatggtaactccaaggtagatgatatttgtaatcgtacactacttgtcagaaatctttctaataacactgctattttataaaaataaacattaattcagtataaaattttattttaaattgttaattcaagcaaatcagtgaggtaacttttacactgccgagcgtacgtgtgtgtggattagtacagccatgccatagacttcacttgtaatcttttctttatattttttatacacctgaaatgttcatcattgtgctgtagaaaacaatctcattgtgtttttaaaagctagagtgggtattgagaaggggaagaggatcatagaaaaagttggttaacatgctacttaacacttcaaatctttactcgatgtcatcatcagcaacattttaaatttatgcttctactagtttgcagttcttttcctttgattattcttatgatacaagcctttccacacaaaatttatgtacaggaattgtgtagaatttttctttggaaaatatggtgatttattacaatttgggcaacatcatcattttaaaaattcagaatttgatttttctcagaatcatcagaaagaataaagcatatatatggttcatgtcaggagaattagaacatgagaattaatatatctctgatcttttaaaatattttcatgtttgtgaatcagcagatttttcctagtttgagatttaaaaaatctagatataattaaaatctcactgatgtttcaccatcagatgattttatatttgtattttcttccacttcataacttgtatagagaagaatagaagaaagaaaaagggaggattgataatctttctctctcagttcttatagcacttcattttttaaacttattacttccttctgcctgctttgtttgtctacatgtttgtatttcatgatttcttagaaatccatctactgccattctgaaggtcatttacctgaaaatgatagaaagcagcatatattcaaacaactgcagagtaattgtctatatcagttatcattgttcattacttttctgttttaggattgaggggctgcctcgccacctccctcacacccccagcatattatcacaaagcctactgattcattcacatccctgggctgaatttgccacccactgtgtgttcctgttgttttgtgtatggaagtgaaaagatttaatttgatgttgttgaaaagacacagaggctaactttcaattttcatatgtagttcttccctctccctctgcaccacctcctttacttgttgagaaaattgccctctccatggtaacaatagaagaagctttcagattttagtagtagttgttgcagagaaaagaattcaaaaagtagatgaagtttaaaaatgaaaaagagagaggaagacagctgggaagaaggcttaatgtttatgagtgggtgtggaggggaagaactaagttgaatgaacaaagctgagctaaggggaagatggtttttctgcatcccagaaggcaataccctagcctttcctgcagccttcactccccaaaagataagagctttatctgaaattcttataggattcattcctgaagagcagcttgtcaccaaacagaaacactgtgatttcctcagggagtcacagtttattattatttttttaatgtaacgcttttgtgaactccagtttccacctcaattcaaatggtcttttggttacagggtgaaagagacccaacaatacacctttcccacttccggaggcctttggttaaaccatgtctgccacaaggacacaggagcctggtatgactggttgttttttgtttgcttttttgcctcctgtgctttctagattgtgagatactgtaactcttgtcgatgacacatagtaccgaacccacccgaagaagtatgtcagtatgtcacattgtgacaaacagcttctcatgctaagtaaatgcagaaccattgtgaaaggtttaataatgcccactcctcccccgccaaagatgtccatatcctaatcccaggaacctgtgaatatgttaccttacatggcaaaaggctttgtattaacagatgtggttaagttaaaaatcttgacacggagagatagcctgggttaccccagtgcgcccaatgtaatcacaagagtcctcctaagagagaaggaggtgatgatacaagcagagtaaaagagagattggaagatgctacactactggcattgaagatgaaggacagggccaagagccaagaaatgcaggcaggctctaaaagctggaaaaggcatggaaaagaatcctcccctacatcccttagagggaatgcaagctctgccaacacattgtttctagcttgtgagacccattttttggactttggacctccaaaattgtaagataataaatttgggttgttttaagccattaagtctgtaatcatttgttacaacagccacaggcagctaatacagccatgaacatttagtaatgactaactttgcacaattttaatacaagcttcttattaaggtttattttttcttaattacaaggaataaaagtggggtctgggggcaatgtcatggtccactccgttttagccatatgaatttgtatttccagcattagaacaaaaggtgacaaatctgaatgtatttgtgtgaaataataataaagcagaacaaaaagggaaaagtgtccagctggaaatgaagttagagaaagatgaggagaagcaagccaattgtgtagttttcccttctgctttttaaaatcatgatttgtttaacccactgaattctattttagaaacaggactgcaaggaagtgttgatggatttggtggcatgagaaccagagtcacagaggcaggaaagtaaggaataagtgttagaataggaagcagagttgcttgggaagagaccttatgacatgtggacagggctagacttaggagtcagaaagacctgagttcaaatgctatcctttagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccatttacacgatattgattcttcctacccatgagcacggaatgttcttccatttgtttgtgtcctcttttatttccttgagcagtggtttgtagttctccttgaagaggtccttcacatcgcttgtaagttggattcctaggtattttattctctttgaagcaattgtgaatgggagttcactcatgatttggctctctgtttgtctgtcgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttctcctaattgaataccctttatttccttctcctgcctgattgccctggccagaacttccaacactatgttgaataggagtggtgagagagggcatccctgtcttgtgccagttttcaaagggaatgcttctatagtacaaggctacagtaaccaaaacagcatggtactggtaccaaaacagacatatagatcaatggaacagaacagagccctcagaagtaacgccgcatatctaccactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaagggcaacaaaagccaaaattgacaaatgggatctaactaaactaaagagcttctgcacagcaaaagaaactaccatcagagtgaacaggcaacctacaacatgggagaaaattttcgcaacctgcttatctgacaaagagctaatatccagaatctacaatgaactccaacaaatttacaagaaaaaaacaaacaaccccatccaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgaggcactatttacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcattcataggtgggaattgaacaatgagaacacatggacacaggaaggggaacatcacactctggggactgttgtggggtggggggaggggggagggatggcattgggagatatacctaatgctagatgacgggttagtgggtgcagcgtgccagcatggcacatgtatacatatgtaactaacctgcacattgtgcacatgtaccctaaaacttaaagtataataataataataataataaaatctcaaaataattaaaaaaagaaacaaacaaatgctatcctgatcctaactggctggctgtctttggggaagttggtaatcttttctgtgcttatttcctcatgtgtaaaaaaatgaatatagtacccagctaggtagagttgttgttgggattaaatgatgactataaagcatctagcccagcttcggctacattatagctgcttacgaaattgtagttacgatgtaaaagagaaaaacactggaaaaggaggatatgggccattttattccaccttcaccaccttttagcttggtgaccttgggcaaattatgcttcattccgtgcttcattttccttgtctataaaagggtgtaagtacagaaccattgaggggtggtcattattaacctacctcaaatggtgtctgtaagttaatatatattgtgcttttcctatgtacaatatctagcacataattacaaatcaaatccatcccatgtgcaatatctagcacataggaaaagcacaataactagttattactcttgttgtagtaattgctacgctgtaggagtttgaattgtaaggcagtggagagtcactgacctttacgagaaagtgtagcagaacatttgagtagatagtaatggggaatattacataaatggatagatattaggggcagatattactattaaaatattacagcatggatatttattaaggccaaactggttaattagttgcatctctcaggttcctaatgttgcttaattttttaacctcccattttgtgctgccctttgtacgaatatttaatgctcccaacacctcttcagtagcacatgtactgtgagtttgttttgttattacttgtgtgtattagcattcctttgtgaaccaaaagcatggaattagctgttgcctctaggctacctagttttgtagtttggattgaagccttcacctcagtaacacctattctgtctactatcttacagaaaacttgtaaaattaagacagatcattaatatagcagaaagagacaaagggcagagaacattgagatactggatattggaaccacccaatagtgttgatttatttatgattatcagtttttgtctctgcctagcctcatgccactaaagtctctgaggcaacaaagaataagcaattttgctcaccttatacaaataaaacacagaaaaaggaatcactagagaaatggtactgcagcctttctgcagggattactgcttatttttaaattacttaaaaggtattgaaattattgttcataatgagaaacctgcctaataaaacagaaaattaaacttaacacttccctataatgtaaacagctcggttaggaacacaacattacagaaaccacttaagaattgattgtacttgttcttggagcagaactagaagctcaccgtttagaagctgtgcacatttccctatcaaacagtacataaagtttccatattcctcagaatcggcttcatttgtgccatgtgtttgcttggaactatgccacagaaagcagttctccccctcaagctgggctcctttcatgccgcagtgcaagtgtgtgatatactggcaccatgtgctaatgtagacccatttttatatgataagaattagtacggcctagggaatagacaagtatgtctaaaatcctccccatagaatatgtcccttcctttaaaagctgtcatactgtaagttccagctgagttaaaggccactgtgctcctatagggaaatatattctattgtaatttttacgttctccaataacagtctgttctttgtttactgaagagagctttcatgtcataaaatggtgttttttgacagagaagcagaatcattgttttattatagaaatttgctcttacaacagcaaaaataaatagctcatctcttaagctcctgatcaatgtctaacacctcctacccccagcaacacttcactgcaagtatattaacactctataatagcaattccactcacctaccaagaaatgatcttcacaaatgatttacagctaaaccagagcttaaacacatagcacccaatcaagggcagatttttatctttttcccagtcatataagttctgagaagaaatagattaatgttgatctcccagacaactgctgagaaaatgtacaaaggatgttgtttattttgaagaatgagacctagttgttaagcactttttccccttatatgtacgtccaaaggtaaccattacaccattttgatgcaaatttaggatatatatttattcatacctctcttctccattcggatgttgtctgtgtgagtgctcacagacacatgcacacatacacacatgcactcctgtttcacacttatttgtaaaactcacaaggatttccaagccattaatatagcattgtttaaggtgaacacatggttgttcaccatccatatgtatcttcactttgtagcactcagaatttggcaaaatcagaaggctgaaacctcatggattaaatatattctatataacatatgtcttaattgctgttactgtaaagaaacctggactagccatatttgactaatttctacctaaggtatttgaattcttataaatagattcattgctttaatcacacaagagtggtttatatgaatgtaattatctccactttatagctgaataaactgagcctgattctatccctatatgggaaacatgaattgaacagctgtgccaattattttgataattcaaatttcacatctaccatgtgaagacagcagaagagggttagggggcttgaattattctgattaactgtgttcatgagtgtaatcgcctctagataatcactcatttcttcacttcacttcccatctacaggtagtatcagcgaatggtaacatctcttgctttgcctcagtttattgatggctgccgttagaaataaaaagcatggttttgtttcagtacttaaatgaataatatcttcaaaatgtttttaaaacgtgaaaaggttgaatgcatttttaacaaatgttttgttagctttgacttttatttttgaacagatgagcacaataccccagtactcctttcctagaaataggagtactacctgaagacttatttcccaaagaaaaatatcaggtctagtgcagcaatacgtattaagggcattgaaaagttatattcacaaaatgtgacatcataacatatgttaatacttcttatcactgataataatccttgaagttgtatttccagagagatctcaatttcttctcacactctgaaagtctctgtttatcctttagagtaggaatgtaagaatttaacaaaacattctgaatgtttaccttttttctaaactgaaactacaatccctttttacccctatatagtaaaatataatattacaagtagaatcagcaaatttgtttaataattctttgggacagtttttacaagcaatggggttgaatttatgttccttgtgtgcagtggagttattatattcttcttaaaaagatgcatgaaggtaaattagaaatgttttacatgttttcatgacaggacatttaatcaaagaggagatacaagaggcttttcttgggttactgcaatttaattttccatttctttcttggaagggacattggatgcagttgtacgaggttaatatttctaacatgccacttttattgtggcattcttctgctctcaaacctctgatgatttcccatggccttcaacatgatgtccttatttgggcatctagtgttctgagccctcacattctggccccagcttcccttctcaacttgatcacagccatcgtaattctgctaactaattacacagctgcccttcccactctttctcaaccactctgctgtattctgacttctacactttagttttaaagctactccttgtcctgaaattccttctcccattaggtcattattaattgagttcatcctctaagttacagttcatgttgctgttcctctatggcaccttccctgaacctggtcccatataaaatcccatctctcagaatcccattagggtaggatatgtggtctgtagactattacgtttgtcatttacatattgtcttctattattgggtaactgcgtgtgcgagcatgcatgggctggcctgaaggtcacctccccaactgcattgaaagttcatcacaagttcaattatttcactagagagtctctttcatgtcatccatgaggcacattccctactgtgatgtgttatgcatacaattatttcaataaatattttctagctctttgattgaccaaagcttaattacctgtcaactctagcctcttgtatctggaatttctacagtctttggatagtatctttaggatgcaaaattaggaggagtatgtaccaggcaaactattacaaataatgccctcaaatagttacatttcactattcatgtcttgtaatttatcttctgctttggtattttagtacacttatgattcaatttgctgtatagattcctctgaatagggacaagagaattcgtcttgataagtggaagttcgaaggattccaaaatgatgttattcaaggtagaacaagaaattaatactgaaaaaattgaggagtaataatccccaaatatgtacatgcgtatctcgttttattgggtttcactttattgcactttgcagatatttcactttttgtaaattgaaagtttgtggcaaggctgcattgagcaagtccgtcgggcacaatttttccaacagcatgtgctcgctttacgtctctgtgtcacgttttggtaatttgctcaatatttcaaacattattattattattatatttgttatgatctgtgatcagtgacctttgatgttactattgtaattgttttgagatgtcatgaactgcactcatatgagatggcaaactttgtggggtgcagtggctcacacctgtaatcctaacactttgggaggccaaggcaggaggatcgtgttagcccagaagtttgagaccagtctgggaaacaaagtgagaccctgtctttaaaatatatatgtagaaaaattaactgggcatggtggcacatggctgtaaggagccctgccagctgcatgggaggctgacacaggaggatcacttgagcccaggaggtcaaggcggcagtaagccatgttcactccagtgccctccagccagaatgacagagcaagaccctgtgtggaaaaaaaaaaaaagacaaacattttttcaactttgattttagattcagggagtacatgtgtaggtttattaccttgatatattacatgatgccgaggtttggagtacaaatgatactgtcacccaggtactgagcatagtaaccgatagttagtttttcaacccttgtttccctccctccccactctagtagtcctccgtttctattgttgccatcattatgtccatgacaacgcactgtttagctccacatgagaacacgtggtatttggtattgtgtttctgcattaattcacttagaataatggcctccagctgcatccatgttgctgcaaaggacatgattttgttcttttttatggctgcatagtattccatggtgtatatgcaccgtattttctttctccagtctgccactgatgggcacctaggctgacttcatacctttgctattgtgaatagtgctgaaatgaggatgagaatacatgtggttttttagtaaagcaatttgttttatttgggctatatgcccagtaatgggatcactaggttgaacgatagttgtgttttaagtcctttgagaaatcttcaaactgtttcactgtggctgaactaatttgcattcccagcaacagtgtatcagagttccctcttctctacagcgtcagcagcatctgtcatttttttgactttttaataatagccagtatgaatggtgtgagacggtatctcgttgtggttttgatttgcatttctctgatgttgagtgatgtggagcattttttcatgtttgttggccacttgtatgtcttcttttgagtagtgtctgtttatgtcttttgcccattttttttgatggggttatttgtttttgacttgttgaattgtttaagttccctatagattctgaatattagacctttgtcagatgcatagtttgcaaatatattctcttattctgtagactgtctgtttactctgttgataaattctttcactgtgaagagctctttagtttaattaagttccacttgtcaatttttggttttgttataattgcttttgaggacttagttataaattctttcccaagtctgatgtccagagtggtgtttcctaggctttcttataggattcttataatttgagatctaatgtttaaacctttattccatcttgagttaatttttgtatatggtgtaaggagggggtccagttgcattcttctgcatatggctaaccagccatcccagcatcatgtcttaaatacagagtccttttcccattacttattttcataagatggcaaacttaatcaatcaatgttttgtgtgttctggctactccactgatcagccattccctcatctctcttcctctccttgggcctccctattccctgagacacaacaatattgaaattatgccagtcagtaaccctacaatgtcctctaagtgttcatgggaaaaaaaagagtcacatgtttgtcactttaaatcaaaagtcagaaatgattaagattggtgaggaaggcatgtcaaaagccaagacaggctgaaagccagacctcttgtgccagttggccaagttgtgaatgcaaaggaaacgttcttgaagaaaattaaaagtgctactctgttgaacacaggaataagaaagtggaacggccttatttttaatatggagaatgtcttagtggtctggatagaggatcaaaacagccacaccattatcttaagcaaaaggctaatctaaagcaaaggactaattctctgcaattctgtgaatgccgagagaggtgaggaagctgcagcagaaaagttggaagctagcagaagtatgttcatgagccttaatgaataagccctctctataacataaaagtgcaaggcagagcaacaagtgctgatggagaagctgcagcaaactatccagaagatcaaactaacatctaagttaataaaggtggcaatactaaacaacacattttcaatatagacgaaacagccttctattggaaaaggatgccatctaggactttcatagctagagagaagtcaatgcctggcttcaaaagttcaaaggacaggctgactgtcttgtgaggggctaatgcaactggtgactttcagttgaagccagtgctcgtttaccattccaaaaatcctagggcccttcaggttatgctagatctagtctgcctatgctctgtaaatcaaacaacaaagactagatgactgcacatctctttacagcatggtttgatgaacattttgagccctctgttgagacctacttctcaaaaaaatgtgtctttcaaaatattactgctctttgacaatgtccctggtcacccaagagccctgaggaatatgtccaaagagaatgattttattttcatacctgctaacacaacatccattctgcagtccttggatcaagaagtcacttcaactttcaagtcttattacttaaatcatacatttcataaaggtatagctgctatattgtggtgagtccactgatggatctggataaagtaaactgaaaacggaaagtcctcaccattccagatgccatgaagaaaattcatgattgaggggaggaggtcaaaatatcaacattatcaggagtttggaagtagttaattccaacactcatcaatgactttgagggtccaagacttcagtagaagaagtcactgcagatgtggtagaaatagcatgagaaccagaatgagaagtggagtcagaaggtgtgactgaatagctgtaatctcaaggtaaaacttcagcggatccagagttgctgcttatggatgagcaaagattgtggtttcatgagatgcactctactcttggtgatgatgctgtgaacattgttgaaatgacaacaaaggatttagaatattccataaacttagttgataaattagcatcagggtttgagaagattgactcaaattttgaaagaagttctactgagtaaaatgctatcaaacagcatcacatgctacaaagaaatcattggctataaaggagagccaatcgatgcagcaaacttcgttgttgtcttattttaagaaattgctacagccatcccgaccttcagcaaccgccaccctgatcaatcagcagccatcctcactgaggcaagagcctgtaccagcaaaaagattatgactccctgcaggctcagatgattgttaccattttttttaggagtaatgtattttcaaattaaggtatgtacattttttagatacaatgctattgcacacttgacagatgatagtagagtgtaaacataacatttaatgcactggggaaccaaaaatattcgtgtgcctcattttattgtgatatttactttattgcagcagtctggaaccaaacacacaatattccaaggcagtcctatatattgtttcatgtctctctttcttctaaaatgtgtgtaggagaaaaaattatatcacttatgttactgggccataatatcaaaagcctgcgaatctgatgcacatgataaaaactggtcttaaacctgtcttgattatcctttgttaatatgccaaatttatagaacaatagagtttcaagaaatgtgaacaatgtagaataactaaaagatctaacgttgaatagctaaaattatcaacgccctttatatcactttagaaatgcgtttgcaaatcattatcaacaaattgtagcataaaattctttttttttcttgactttgaaattgtatttcaagatccgcaatttacaccacattatttacttactggcttgtgaaagtgaaaggcattttcatttttggatgttaagggttttagtaaatgacaagtaaatcaatcctttaagttccgtgtggtataatagcttggaaaggaccatcttaatctttttttcaacacagggagataatttattttaaaaataacacactaatagtagattaatattattaccatttcaaagaagtcaccaaatttggtaggcttaagaggttttttttttttttttgagattactatgctctttttttattttatttattttatatttatttatttattttttagttttttaattttactttaagttctgggatacatgtgcagaacgtgcaggtttgttacctaggtatacatgtatcatggtggtttgctatactcatcaacccaacatccaggttttaagcccccaatgcattaggtatttgtcctaatgctctctgtccccttgcccctcaccccttgacaggccccggtgtgtgatgttcccctccctgtgtccatgtgttctcattgttcaattcccacttacgagtgagaacatgcagtgctaggcttaagagtttttttaactccccaaaatatcaacaaattgaaacattactacaaagaaatagagaaataaatttcactgactgtcttattgttttttaagtttgaatagctaataatgatttcttaaacagctatcatattttttatttttaaagctagccaaatgatcagtgatttttataatactgataaatactgcttagaaaaggaacatgtgttctagcaatttccacacatttctgattctaattacttgtttctttttgttttatttttatatttttaagttttgtgagtacctagcaggtgtatatatttatttggtacttgagatgttttgatacaggcatgcaatgtgtagtaagcacatcatgtaaaatggggtattcaacccctcaagcatttattctttatgttccaaacaatccaattatactcttttaattaatgtaaaatgtacaattaaatcattattggttatagtccccctgttgtgctatcaaatagtaggtcttactcattctttctaactaattttttgtacccagtaactatacctacaccacccccacctccccacgacccttcccatcctcaggtaaccatccttctactctctatgtccatgagttcaattgttttgaattttaaatcccacaaataagtgagaacatgcaatgtttgtctttctgtgtctgatttatttcacctagcatactgacctccatttccaacaatgttgttgcagatgacagaatctcattcttttttgtggctgagtagtattccattgtgcataggtaccacatgttctttgtccattcatctactgatggacacttaggttgcttccaaatcttggctattgtgaatagcgctgcaataaacatgggagtgcagatatctcttcaatatactgatttattttcttttgggtatatacccagcagcgggaatgctatattatatggtagctctatttttagttttttgaggaacctccaaacggttctccatagtggttgtgctaatttacatttccaccaacagtatacaagggttcctttttcttcacatacttgtcaacattggttattgcctgtcttttggatataagccattttaacgggagtgaggtaatatgtcattgtaattttgattttcatttctctggttatcaatgattcagtgatgttgagcaccttttcatatgcttgtttgccatttgtatgtattcttgatctgccacaagtctctaattacttgtttcttgtaccactgtttcccttcattgtagtcagtgatttggtcaatcaacactttttacgtatgggtatctgttaactgtatttctaggaatggaccaagaattgagaaatttatcccaaccagaaagaacaaaatctatggaggcacaggattactgaaagctttgctcctatagcctcagtttttttctgcaagttcgctgcttcccagttgtccttgtgataaaattcaaaacctcaaactgatttttaaaaagccaactatatactgcttctactatgtctacctaaacttatttgccattatttgtaaagaattccaggctctaaccagcccatttgaggctttattttacgttcatgcctttgttcatgtctgtctttcccttataatgctcttctcattctctagccaaatctgccaaagttcagctgtagtgccatacttgatatgaagtctttgctgagaattcccatatgtggtcatttccttcactgatttgtttcaatagttgttgccattattattattttttttatactgttgctggatactttcgcagatccaatctctaacctgttgttctaccctaggaggttgaccaatatggcagtagcattgggcttgcttgtctattggcttggtccttgtgttgggaggcatcagcagatcaatggatgagaggagagtgagtcgagggatggctaggttcctttactcacagccccagctcctgtcaagaggtcttgtccctgcagccacttctcagattctactaactataccctccccttagcctttcaggccttgaggaggaaagcctcctcatcccactttgaatgaactatttattgcaagaaccatgactgattcagaatataatctgtccttgaatgaaatagttaatttccccttttgtattctcgtttcatatccctgtccctttatccattcctatattatatcatactatcatatagctaccttatattatactatgacatgagtaccttgtaagtatatcatgctatattatagttcttaagtgtgtgggctttggggccaacttacctatgttagaagttctgccacttattaccatgtgatcctagacaaattgtttaacttctttttcattcattttctttactagtaaaataggggcaatattagtacccacctcacagagtaatatgataattacattgactgatagtttttatttaaaacttttattgttcttactatgaaatgggaaatgttctaaacaccttacaaatattaactctattaattctcataatgaatctgagaggtagagactcagtatctccatttcacagtgctggaaatgatacagacagcatttaagtaacatactgaaaatagtaaaccgaataggtggcagccagtatgcaaattgggaaagcctgactccagagttcattcttttaactagtatgctgtgatagactcttttggcatatggtatgcactcaataaacaactattgttgttgtcgttagcattacttcccattgtattattacacaaaaaataattgtttatgagtatttgtttgctagattataagttccttgaaaaaagaagacaagttttatttgtctatgtgtactagctgagtgcttggcaaatagttgcagtttagtaaatgtttctaaaacaaattattagttgtttcttatgtatttcccaagtctatcctagccttggaaacagctaacacttagctaaacctagaaatgtcatttgagatttcagcagccatcattgttgctgaagccacaggttctcctttttatctccaatttcttcctcagatgattcaccactttctttgtcgtttccctacttcatttttcctatagtgacttttgttctccaataaccattgatagtgatgacagtcccaccttggaaccacttctaactgtcctgttcagcttttcctgaggccagatttcccccaaaatacattttttagcttcataactgctccttccagaaatttgaaacgcattctcaggaattaagcaagaggcatttgattgacgtcatttaatttgtgtttaaatgtgttcttcccatcaacgattaaccagtgcttcagccaagatacataacttttattctccactaaccttagggttgaggtcacaatcaggtacgtaatctgtagagcccagtgaaaaatgaaaacgcagggcccttggttaaaaaaaaattaagaatttcaagatggcaacagtagagcatgaaaccaagtatgaatcccttctaatgcagatccttgtgtaactaactgcacaagttatacgttcaagaagctggtcctggttgaggtctttgtctacctagggcacttctcactcagagaggtggaataatcttaactttctgtcttccgtcatctgaaaacttgccccaaagttccttttgccatctcttgcagcaaacctagtggttgttatctgttaaggattcctggtggcttgctttagtttcctacagttcttgagctgcatgtgttgaatggaactccaccattaccatgtaacacatctgaatactcttattttcctccagttaaattctgcgctccttggaaataatggtcatgcaccctaccttagtgatttctaaatagaggtagtatgtaaaaatacatatttacttgaattgcatcttaagaggccagcccatgggaggcatgaagaaacctatgttactaattaatattcaataattgacagttacacattcaggtagtagtgtcatggaaccatcacgttacatggaactgaagagctgatgagaggtttagggtctaggaggacaaaagtgagtgtattagtcagggcctgaggttatatgtacccagacaggataaaatgggacaatattttattagtggaaatatctatgtgaaagaaaagaaggaggaagccaaggaaggtgcaagagatgttagatcaagatgcaattctgactctgcaaggaagagagagggagagaaggctaggcagaagcatcccagtgtgcggtctagtggaaggaaattttggcaaagctgttgggaagtcattgaggcagagccaggcaaagaagtcccatgtctcccaaggaaggctctctgccttagtattcccaccacacccaatcattgggtgaggagaagtctgtgagaagcttggctttggtgcagtgcaatcatggatttcaaaatgcagtaacaggagtcctcagtcagttaagacccaataatagaaggcctgcatattctcatggtggccacttgggtatgaggagcagtggtgtttaaaactgttttgtataatttaaataaagaaaagctgaggactacttaagcttgattccttcagaagacagtctttggcctttatatttcatgtgatatctttgccatatgctctgataactctccatgtttcccctaccataatacctcaggttgttgcaattgcttttttattgcctgtcatcactactcgtttgttttctctttgagaacaggaattattttctccttcactgctacagcccctgcacctagctcaatgagtgacacaacagaagcacttaaaaaattgctataactcaaatttgggggatattctacaaaatacctggcctctgttggtcaaaactgtaagtgttataaagttcaaagaaaggcaaataactatttcaacttaaaaaagactaaggagatacgacaactaaaagcaatgcgtgagtctggaccagaccaggaaataaaaatatagctataaagttcattaatggggtaattgtcatactctgaatatagagtatggataagattatggtactaaagccacgctaaatttcctgactttgaaactgagctgaggttatttaagagaatgtctttgctattaagaaataaaacctaaagtatttaagggtaaaggggcatgatatctgcaaattattctcaaatgattcagaaaaaaaatatatatatataaaacattacatatacagttatatatctatacacacagagagaatgataaaatgataaataattaaaaataatgtggcaaaatgttaacaaatggtgaatccgggcaagggttacctgggagttctttatcttgcaaatattctgcaagcttgaaattatataaaaataaaatgcatcttataaagtatttattcagtgaataaagaacaaaaaaggctaactgcagttggaagatatttatgaagttggttatgaagattcttaagaagttaccgatggaggtgctagtagaacattcaaaaaagaagtagggaaggttgaccaagtaggaaaatatcaatatccaagccagtataaaatggaaatgagaagtgaggaagtaagtggaagacaatgaggatggttttcgatttggccactctatttggagaggcagccgaatgcaagaatagaagccagaagaagatgctcagtgagatggttgaaagctagatagattacagcatcctcaccagtaaaaccctttcggtaactagaaaggctacaatttagtaccttcctgacttctatgcttattttcttcaatacataaaatggttccgtaaactcttttaccttctgaattctttatattaattttttgaagttgtaaataaaatagcatcagttctacattgttacatttcagcttaattcatattcatttactgaaaatgggaacatttgaaaaatcatcatgggcatttatgctatgtagattgttgatttttatagaaaaatataaaaatatgaccagtttgattttcaaagtcttttcttagacatgtaaatactaagcattcaactcaacatatagagtttttatttgagtattatttaggtggaattctattttaatgaatacaataaaaaattgtaattttgtctaaaagcctaaaatgccctagttataatatgtatgatttcactgtttaacttcctatttcatagggttgctatttataaccacttcactcaactctggggggacttagtgagattaaagacttctgattcactttgtatttgaagaattttttttcctccatctttgctcagctagtggaatccatgatgaattctcatctccaaggggtaagcagtttttagtaaagcccagtagctgacttatgactccttagaaatagcattgattccttccttctcctgtgttttgtttcctctagaatgatagaatccatgtagacacgatccattatcatgcttaggtactggtaagcatgtaatgattttagttttgttcgctttaagttatttgtgtcacaaatatctgggatcatatcagagaaataaataagcacaattagcattctacttgtttgttatgactaaagctaggttgaggaaacagaaaaggaccagaggtcatatgaggatgaagataatactaggaacagcatgtttgggagagtaacatctggtaggggtagcagattgggggcagagaacagaattttatagatggatattttggaggcaagtagtttgagtaatgattagatctaaggtgttttctcatctgtgggtggctcgaaggaatagaggtgaaggtcagtttatttgagaagttctggaattataaaactaagttgaagtcaaagaaagtatagtagcaaataaatagaatacccttaaaaggaaaccaaatgaaaaataatcgttactctcaccatatgcttgtgttcttattagcaagaaattcttttaaccactgtttttataatatcttaatgaaaaaatactgaagcgtatgccatattaaatccctctctttatttctagaaagggaatcaaaggagaaaattcccattctgctatactaaaagaccactaagtaaagagcctattagtgtatgataaatcccatagcaatatacattatcattttacagcttctttgttgaaatgaatgtttgtatgtgttgaccatagagtgggataaaaagttgaaattttgttttgaaatattttagaaatgcatagttgtactgcagttgtgaacctccttagatttttaaggaggctgcttcaaaggatctcattaataatcttctcaggtgcttacaaagcatgtgtctgtcagcagaattagagaatcacccaactagagaacaggtttcacaataccctgagacctattttgttcattagagaggaaaatggcttgttttgagtctaagttgacatgcttgctaatttcagcaataaaagctgttcattgtggtcaggtttaatttagagcctggtaaggttcagattaaagttgatcaacttacttttacaacatacttcttaaatgaactttgaaatcttaaaagaaggaaaaaagtatagcaaacagtgaataatgtatctaaaactgagaagcaaaaaaaatctggttatgtgagagtgaattaaaagaagaacaacccaataaagataatctttgttatataaaaatttccaagtatcgaaaagcacgatttttcatgtgagttacacactataccgaatatatttgtccactgccacatgcatagtccctagaatagtgcctagtgctgaaaaatatttattaaaatgaatggatgagtaaatgaatttatgtattttgccagccctgtgtatttaaagttctctgttaactttgaggtgaaaatttgacttcatctgaggtttctgggtaagtccgttttaaaaattctattgaacatattcaaacattttagggtaggcaattccaaagcaacctttcagcttcccatgtcacagatgaccagagtttcacattctaacactggaaaacatcttatttcataaaatctacctgctactatatggttcctactttaaaatttgttcagtactctccagctgacttatgccacttacttcaatagctgtctttggcaatttgttccatatttcaaacactctgttgtgtaaagaaaccataaaagttagaaacctgaaaattggattttttttctgagcaatcacagcttacaaatgtggaaaatttgttaaaagttagcccctccaatttttcaatacagagaggagaaagtgcctaaagtagatgtacaatgtttggaaaagttttttgcattattttactattaccaaaagcaattgagtttaaatcacaaagcctgtctccctacctcttcacagaagaaacactacagaatgatcaaaatttggcctttccaaaaccaaaattcgttagaaaatcagcaggagtcaaagtacagagtaaataactaagtttcatataagtttcagatacattactatctaccactttcatctcttcatcttcattggcctcatgtggtagaacatcatatttaaaattatacaaacttgctggcttgtttactagtgtggttattataagaaaaaaatgagaaaatatagataaaacatctgtcacatattgcttataaactaacagtaaatattacttgtattttccccaattaaaataaaatttactgagttttagaaccagagctagtcagatgcctttttttcataaatttcttcataaatacctctgagattgtggtccttaaatctagagagactaagatgacagagaaaatagacactgaagaaagggaagaatatcttaatgatttacattactacctataaattaaaaattgttaactttattatatttgtatttttatttaaaatagtgctatattaaagtcatttataatacaggggaataggaatactaacctgtaatctgatgctctccaaacttgcctaaatcataaaagttaattagataatttatttaaaatgcaagatttgcagccctttccactacatattcattagttctggagggaggcaaaaaggtttggtgattcttacggacaggcagcttaggagaaaagctgatttagctcgtctacttcaccttttcatttgacaggtgagaaatctcaggggtacaatgaagttaaataagtaatatctcttaaatcggttctgtgctttttctgtttttaaaataaatataccttaattttgacgtcacacagaatgatattataagtataaatagttatctatcttttaaatacattgtcgtaattcagaataacatttcttactcaaggcattcagacagtggtttaagtaatccgaggtactccggaatgtctccatttgagcctttaaatgaagaaaatctatagtcaagattttcatttgaaatatttttgatatctaagaatgaaacatatttcctgttaaattgttttctataaacccttatacagtaacatcttttttatttctaaaagtgttttggctggtctcacaattgtactttactttgtattatgtaaaaggaatacacaacgctgaagaaccctgatactaagggatatttgttcttacaggcaacaatgcaggatttggaacagaggcgtccccagttggaagaactcattaccgctgcccaaaatttgaaaaacaagaccagcaatcaagaggctagaacaatcattacggatcgaagtaagttttttaacaagcatgggacacacaaagcaagatgcatgacaagtttcaataaaaacttaagttcatatatccccctcacatttataaaaataatgtgaaataattgtaaatgataacaattgtgctgagattttcagtccataatgttaccttttaataaatgaatgtaattccattgaatagaagaaatacatttttaaatcaattcagggcttatatagttgcaaagcatgcattgatgggtgtggtgaccacagtgtggcagaacatttgtggcagaacatttgttctttagttgtcatctgggctggcatccatggagatgccagtctctccctcatatccttggctgttggtccaagcaggcagtggcttcttcctgggccatctttcattcccatgtgcagtgactttcagatctggatatctctccgctactttgatgcccccattttgtaatatcaaaaatcatcgtactgtaccttatgccgtagtagggtgggcaggaactttggtaagacccatctgactagacgctgtgcatattcttttcttctgacatacactcctatccatttaatggggagagtgattcgcagtgattgtgtgttgtgtcagtgagtttccatggggtcaggaagagtgacagacgaaggagtaggggaaactcgccacccggtttccctcagagattctcctcagaaatgaggtccaagtcagctctgctttcaggttctctcagatctctctcggtttcttcacttctctctaccttccttccctccagggacacacactggtattgaattttcttgcttcctctgcaatatcccctcattttccttcccacaacccgaagaatcctttgtagtgcaggaaggaggaaaacctttcagccatctttttttttctctttgaaatcttttgtcttttaccaggcttagacttttcaaactcggaaaccatgagagtctatatcttcataatttatattctgctatgttaacccttccctaaggaaatgactagttgtcaatatgttggggaaagtgaaagagtaaccagagtaaaaggttaatattttaaaatattattagtcatacttccacatattgggtaagtacttattgataatagctagtatttattcagtacctcataagcattagatggtgtgtgcacatgtgtgtgtttctgtgtgtttctgtgtgtgtgtacaaaatctttacagaatcttgtgagctatattttataatccccattttatagacgagaaaacaggttccaagaacagttactcggccgggcgcggtggctcacgcctgtaatcccagcacttggggaggccgaggcgggcggatcacgaggtcaggagatcgagaccatcctggctaacacggtgaaaccccgtctctactaaaaatacaaaaaaaaattagccgggcgtggtggcgggcgcctgtagtcccagctacttgggaggctgaggcaggagaatggcgtgaacccgggaggcggagcttgcagtgagccgagattgcgccactgcactccagcctgggcgacagagcgagactgcgtcgtttacaaacaagcaaagaacagagcttggaatttgtaaatgtctctttctgacttgaaaatctgcgctctttctagtatgtttaccatttcccatcttgttttgttgcttttgttaatgaccttaatcattgtactaagactaaatacttcttttgtctgaaattatgtatgttttgattcacttcctaaagacatgtcttctttcagttgtagtgattgctaattaaaataggctgttcttggttttgaaagtttaactctttattgttgcttaaacaatgaatgtggatgtatgctaatgtattatttcagtaacactagccactataacaggtaatctcccaaatcttggaggcttactacagcagaaatttacttcttattttagtgcagtccaaaataagcagccctctatgaagtcattcaggaacccaagctccttccatcttttgtgtccagagcataagactcatatgcatttaatgggcagatgaagaatgagtattactcatgaaaatttgtcatgagccacgcctggaaatggtgtgtgttaattttgttcatattctgttggatggatcttgtcacatggtcacacctaactgcgagggaattagggaaatagtgtacactgttgagcctaggaagaggaacagatttggtaagatagccatacaattgatttagcagagcattcctccaccatactggaaccttgagggttctccaacaagttgcaacacactgacccaaaagagtgaatcttagtgagtgatttactcaatatgagactgaattcccattacacaggtaagtgatcagtttcttgcctgagaaatatggaaatttggcagtgaggtttatgcaaatctgaacatactatacagagagtcatttgttattttactaatgaaaaatcacttcaattttttccctaagaggaagacaatatgaatgtattatacagtatttgttcaacattgtctgaacattttccattatcccctgcatttttttttcatattgcattgactttttcatgatagagattaaaattgaatgaccggagggcaagtttgtatctctctgccaatattcagtgatttgaatagttcttcttttctaagcttttgtcttttaggaatgaatacctttatgaatatttgcagcctagtggaaaggctgtaatccaaatggtccaagaaagcattttcttaaaagcaagtgtctgtcgagatgtgtcatagcgcttattaagagtctaagctggaatcttagttccaaatatgcctggagcctctaaatggtaccaggataattctgacaagatatgtttatctaaacaatgtcatttgcagccctgctacacttcagtttatctctccctttgaaatctataaaatgggatggaaattcaatactcataaacttttcgatcgtgttcaaaatagaatttttcttagtaaagatttggttttcaggaaaaggacagaaataaaatacttgctcataaaattgtattttctcatttgatgattttggtcttcctttttattgccatgaaacttctagaaatgctcaaaaagaaatcagctaaataaagaaaaaatagttaatatatgtatgtaatactatattgaaacatttttctttctctggtaaatcccatttcataactttgaacagttgggaaaatctatacatagttattgcagtctatcaagagaaaagttcagtacaaagctatttatgtctactagaaatattcatgttaaacttcaagtaattgggtgtgcaagccaccaccatgttttactatatgaaactattaccgtggtatctgttgtattcaggtaattatattgatggaaatcatgcagtaataatctaggtaagagagtaaattttgtctaaatcagatcaaatgaaaaattctccctctttctaatattcgaattgctcatttttctttaactctttggtgtctgaatttgtcaatcattcctggccattttcttctgcaaaagggctgggtcaggggaccaaaagcagataagattagaagaatttaaattttcttccttggaggcgtctgaattacatgaaactcttgttcgtgtctgttaatactgcaaggcataataccataataccttgcatagcagtgaagaggatttggaaagataaaactgcttccttttatcattctgtttatttcacaaacaatattggtgaatgtcgttcctgtaacatttggatttaagagccttgtttctgtagcttctccctccgtaacccccaccactaccatttcggggctatacagcaatagcatgcattactttaaaaggcaggctgcctagactggccacttgttagctttgtggccttgagcaaatgactaatctcagtaaactatctgctcttagtttccttctctgtaaaataggctcacttataactatctcatgggttgggaggattagatgaaataattaatgtagagcccttagatcagggccatagtaaaagctgaatgaatgttagcatttgttattttaattataatctattggggtgctttgaaggcttaatgcaaaatacttaatgagctttttggtagctgtttagttatttcgccccccaccaccaccccaaaaggagagatttaaaagaccgacaggagaaggttgcttggaaaagatggaataagatctataaatagaattaaacaaatattcaggaaagccttttgtgggaaatactgcaaaatttttattatctataaatttaataggtagataaaattactactcccattttagagacagaaaaccgagactcggagagctaacgtaacttgtctagggtcttaggaagatgacaagtgaggaagtagaattcaagcccacgtctatatgattttaaagcccgaggcacatcaaatggaaaaggctggttagtcagaaaaataggaaggtatatttatctgacaacttaaaatattaggactaacctcaggtaattatagtctggatatacatttttgctgctcctgtttatacttttgacttctgtgtatttgagtgtctaatcaaaggattgtcttttacatgtgttggagatgtacagactagtggaccccaatgatctattagctgtgtaaccttagccaagttaattctctttcctaaactgtggttctctcatctgtcatgtggggctaataatagtacttatgctggtagggtgattaagaaagtaaaataattggtgtttctaaagtaaatatgtggcacatattagatgctcattaaatggtacatattgttatggtgagatggatttggtacagagagaactggagatgggagaatatgaagggtgtataatgtggccttttattagctaaaccaagggaaggacttctgaaacagaattccaagttttaagagggagtcgtttattttggaattattttttcagctaaggatttttcaacccagtccagaattcttagagaaatttagtgatagcttataaattttaagaaaaggaattcacattatattgcataaagaactggtatacagggccatagaaggggagaatgttcttctgtatgagaataaaaaaaaacatctctcacacgatttttgaattaactgacagttttatagcagctttgtcaacccatcattcattgctgcaaccaaatctatgaaatccttcatggcgaaataaaaaggctctgttgttctccacatttgtatgaaatctctgttgctaatgaaatgccagccagtatcttcctctcaggtattgtctattagatggttgcttattttagaagaagtggagtcaaccatataaatttccttcttttgacatctagcacctgctgtcaacctgttatagctacaagcagctctcaaaattcacatccactaggatgccgctggcaaccaaagagttcagttcagttcagcgaacgtttgaatgcctactctgtgctatctaatatcagagatggtagaggggatacaggaaaaaagtaagattcagcctttgtctttaaagagctcacaatcaaatgtgggtatttggacaagtatatttaggcaaggcagtttaggataggtgcttcagtagagcagtattacaaaatgttgagagaaaactagaggaggagttttaaatgagggcttagtggaatgcttccaggaggaggctgaatttgacctggtcatgaataagactttgaaaagcagaaggaagctggagagggaagggtatttcaggaattgatgacaggagaatacataattagacctgttaacagtggggtggaagacgaatatcagcatgggagtgtgtgtgtgtgtgtgtgtgtgtgtgtgtgtgtgtgtgtgtgtgttgtggaggataagggagtaaatgaagtcagtaagaccagttagaaggcaagagagcccaagctggagcagtgaccatggagtaaaaagaaagaagtgaaattgagacataaggtggagctagaattaacaggattttgacattgattgcatatataaaactgtcaatctaagagaaggcctgcctctaagagttggagattgaattctttggaagattaatgtcataaccagagacaaactcaggataaggagttgattatgggagacaaagtaatgtgcttaacatgaagctagatgaccatactgagattttaaagaaatggttgaaaacatagagattgcaggagtgatgttacttttggacaagaattcaaaagttacctggaatgtctgagcttgcacagagagagggtacctggtgcaaagaaaagtgaacctaggaaaaagcctagaagttggtttacatttaaggaatttgagaagaggtagcaccacccaccccccacacaacccccaaccctgccaacttacaatatagaagcatttagacacacactgaataataattttttttttgagacagagtcctgctccattgcccaggctggagtgcagtggtgccatctttgctcactgcaactccgcctcccagattcaagctattctcttgcctcagcctaccgagtagctggcattacaggctcccaccatcatgcccagctaatttttttgtatttttagtagggacggggtttcgtcatgttggccaggctggtctcaaactcttgacttcaggtgatccacccgcctcggcctcccaaagtgctgggattacagacctgagccaccgcgcccagcctaaataatgaatttatagatgctacactgtatggtttcctttttctgctgctgtacaaccattcaagtaacataagtttcatcctggttcttaatgataccatgaataaagtatagaaactctttagctgaggattaaagattgttgtgtttaggtagaccaggtttctgatgcagccctcagtataccagggaaattagccattactgtttgccttgtaggtctaatgaaccctttagctttttattttgtatatgtctaagttactctacaaattcttatggaagtataaagagatagtgaaagacaatcttatgagaaattttaataagaattgaaatacaggctgggcacagtggctcactcctgtaattccagcactttgggaggctgaagcgatggatcacctgaggtcaggagttcgaaaccagcctggctaacatggtgaagccccatctctactaaaaatacaaaaaaattagccaggcatggtggcgggcacctgtaatcccagctactcgggaggctgaggcaggagaattgcttgaacccgggaggcggaggttgcactgagccgagatcacgccattgcactctaacctgggcaacaagagtgaaactccatcgtaaataaataaataaataaataataaaaaagaaatacaacttactttttgtatcaaataaattttggtgcacaaacatcataaatgacataatatctgtcacacatcctttagcaaaacaggattgttaaaattcttacagctaatattatgtggtgaagttcttcctgttgaataattaagtggattaaaatatcatatttcctttctgtcattagaaatatattgtgcattaatcagtccttgggcctgagaacatttatctaggttttcatcatctgaaaactcacagtccaatatttcacctgtattatcaattcaccattatcattagagtttagaatgctgctgtctctttccatctatcttctgttgtatctaataattaggagatatatatatatatatatatatatatagagagagagagagagagagagagagagagagagtgagagagagagagagattggtaataatactaatatatataataatattatatatatacacacatacagagagagagagagagagagagagagagattgattttaagccattaactcatatgattgtgggagctgaaaagtcaaaaatctgtaaaatccaaaagcctggcaggatggagaccaagggaagagttgatgttgcaatcttgagtccaaaggtaatccgatagcagaattccttccttttctggggacttcagtcttttctcttaaggacttcaaaattgattggagaaggcccacccacattgtggagggtaatctgctttactcaaagtctgctgattgaaatgttaatcacatctaaaaaataccttcacagcaacatctagattggtgtttgaccaaacaactgggaaccatagcccagccaagttaacacataaaatttaccatcatcagccatcatcatgaggttcataatgtcatgtgtttcttcacatataaatctcgtggttcttttatttttttagtagtacctagttaataaggtacctggaaatatacgttaaataatagaaatggtctttaatatcttaatgaatttcagagttctatcagagtaattgtaacttgtatataaaaactgatatataaaaaacaagtatgttttttcttcctatacgttgtgttaaattaatactaattacctatcatgaaatgaatgttttccatttttcataaatgtatttcatttttaaattaagaggattaatatcaaaacatatttgaataggatttaaaatccaaattacctgttgcgattatatttaattataaatctttcaagtgagtttataataggaaaaatattttttattaaagtgatgtaccataattatgaacataaatagtgttttctactaattgtttttgtcttcattatgtttctttttaaggggaaagatctgggttaacaaatgttttattcatccaccttgaaaattaaacataataaacaaaactattaaataaataaaccaattaaagaaaatagtttttcttccttttttgtgataaagatgattatgagtaaatatattaaagaattttatactcagacaaagtgagctaataagacaaatacaaacagagatgagcccagaaagagatactctacatgtttataggctagcatttttatcttatgacctacagggtcattgtaactaaagtcttgaatttctgttatattttggtacctgtgggcataaataggaatattactccctgatggcatcatgcattttagataaaactaagccaagggttaaacacgtgccatggactgttcctaaaaaatgctctcagctctcaagttatagaaaattgtagggattattattttgtacctactacttctttctttaccaaaatttacttatacatgatttgaaaattgcttgccacctgtctttattctgttgtacttgtcttaagtaaaacatttataaagtaagtaggaaggattaatagattgtgacctttctacatgaaaaggggaaagccgagcttgttctacttttgtcaggaaagagtttgaatagttacctgttactgtaaaacaatcaccccaaacttagtgtcctaaagtagcaataatcatttattatcactcataggttctgtaggtcaggattcatgcattgcttggttgaggggttctgtctcacgatcactcatgatgttgcactcagatgtcaattaggctgcagtcatatgatggcttgactggggctgaaggattcactttcacagtgagttacttgtatagcttgtgagttggtgctgtctagttggtttccctctaaacgagttcctccatgggactacttgagtgttcttatgatgtggtggctggcttaccccaggacaagcaacctatgagttttgccctgagttttctgaaacatgatcccatgttgctttgaatatccccattagacactcccacaaatgtcaatcatactctttgccctaaaagttgcagactacttgtacatgtcctttatcctacatgtgtacaggaaacacgtgcagaataacatgtgtttttgtttcttgaaagaaacaagaacccaccaaaactttatagctccgggacatgatgataattatctcaggtccactcagcctggctccacatggaaaatatgggtattgtaaagaaagcttttgaattttggaggcctaacaaaaagacctaggaagctaatagttggttatgagataattataacaatggtgatgaaagcaattgcgattattacttttatgttagtgagataaatacataagaatgtccttctttaatttcattccttaatttccttaatccccattcttgatttctggattagaggaaagctatactatctacctgattacacaaaaagactggactgaggggtaaccattaggactcttgttagttgaaggtaataaactatattacttcagtggctaaaacaaacaggagcttttttctcatataaaactagaagtcaggaaacaaatggttgctgatgttggtttatccgtttgacaggttctacctttatcctggagattctttggcctttatttctttagtaatatagtagtaacagcactgaatctaaaataagagcacttggtccaagcactggctctgcccccttagtgacagtgggacccatggcaaattatttaatctctccaacagttaattttctcatctgtaaaactgggatcctgataacttccatactagtttggtgttaggattcaatgaaatgacgcatggaaaagtccttttcaaatggctactcactatacaaatattaatgtcttagtaagctcaggctgctataaaataatgccatagactgggtggcttaaacaacaggcagttgtttttcacggttctggaggttgagaagtacaagatcatggtgctgacagatgtggttcctggtgagaaccttcttcttgctgtatcctcgtatgttggggagagaggtggtgcagagaggtactctagtctctcttcttgctcttcttaaaaggacactaatccaattatggaggcctcaacctatgacctcatctaacccttattatttctcaaaggccccacctccaaatatccattgggggttagcacttcaacatacaaattttagccggcgggggggatgccagcattcagtccataacaatcaactatcctcattattgagagttccactaggccttctcaagggttgacaatgatagtgccctgctagctataagagtaaaaaaattttcacatctagaaaatgggtgcacgaatattggtaactgttctaatgtctatgcacagaatttttagaacttgctcgagaaatttgtctttcctgacagtgttgcttctcttaaattccagtcgagggccttgaaaaaaataggttttccatcaagattctctgaatgaataaatgaaatgctctgatattttctttcaatattaagataaagcaaaatgtatacagaattttctattttcagtgtttccaattactgcatggtttggcttattaccatctctaagtctaaccctgggtcataggagtaaagccattgggggtcccctacaaaggatacaaggcagtggtagatacaataagcctgacaattggagtcagatttttctctttcatacaggaaccatggaactgttgccctgggccacagctggctctcagaaaaacgtagaactggtcgaggaaaggaaaggcagggagtccttgattcacttgttatcagaaaattgtctgttcaaacaacagaatgtttgaaaagataaaatcaagtctcaaatgcacagaataagaatgaggggaaaacacctttctctgtaattaaacagaaaagtgtgccatgaagtgataaaacccagtcaacctgaaaatgtgaacatcaagtgtaattgtgcagaacgataaggtaatatgaacagcacaggaatatataggctcacgttggcattttaaagcaatggcactttacctgttcctcatgaaggatttggtttagtctaatcccttgtaggagccactaagaggagaaggcacagtccttttgggatgtaaaatggggaattctttctatgattacaagaatttgtaaattgctcagagttttaggacagcaggttatgtgtctctcaatgttgggtaccatgccaaacgtactttaagagacatagcaataaatagaatgggattcatttttttcttaatgtctggcagggcaaccaaaatgcccacgtttcccttcagtagcttggtattttggtaactaaaaacatgttccagggaactccagaatatgaaacatttcagacaatttgaaactgtcaaaattttcacttctttatgggacaaataaaatctaactttattcagattttaaagtatctcataaaagagtaatactttagatttgtgctgtgctttatacgaattggatgaggaactcttatacatatataagtggattttattttcacaacagtccctatggtagatattgtccttattaagtaaatgagagaaccaactatcaaagatattaatattttgcataagatcacacagatagcggaaccaggatttaatccaactcctctgattctaaaaataggtgttagatgggtattctttccccaaacctatgctgaaaggaggctacatttggagtcagttattgaaagtttaaatatatgtgtatatatatatatatatgtgtgtgtgtgtgtgtgtgtgtgtgtgtgtattcttatatactcatgcatgtagatagttataaagtacatgcttatatgtcaattttatatatacgactgatatataaactatcaatttgtgatagtttatttcaattaagttcaaacatattgggtatttattgactcatgggacttaaaatttctcagaggcattaatttctatgcctttaagcaaaataatgtttagcccgttttagaaagataaaaggctaacatatgttttgtttttgtttgttttgttttgttttgttttgttttgttgagatggagttttgctcttgttgcccaggctggagtgcaatggtgcgatcttggctcacagcaacctccgcctcctgggttcaagcgattctcctgcctcagccatctgagtagctgggattacagacacgtgccaccatgcccggctaattttgtatttttagtagagacagagtttctccatgttggtcaggctggtctcgagctcccaacctcaggtgatccacccgcctcggcctcccaaagtgctgggattacaggcgtgagccacggctcctggccgctaacacatgtttttaaaaaataaacaccattcgagtaggaaaagtgggagaactggtggttcagctagagatacggagatgggagggcaagttgctttctcatgttgccacatctgtaagttacaaatgccatagattaggaatttcaacgttgttgtgtctctctgaggacattctccatgtagtatatgtttcgcctccctgatggacagtaagcatcaaacggttactcctttatatttgaattattttaattctaacatcttgttctgaaaataacgggaatgccataaatacttactgattgattggactgtctcgcaggggagctggcagctagtgtaggctacaagctgccatcatcatctccatgaccatgagtcatcactggaattaccctaaagaggttaataaaacgccttgtttgaaaagcaaacaaaaagccagaagaaacccaaagcaaacagacccagactttgcaatgggtagtgaattttcagtcttaagggattgagagtccttttagtacaatctctcataaacatataacagattttaaaagcaccttggtctgattccagttcacatacctcatccttgcagaatacaacatactaggccatttgaaatgttcctcagtttacttttggaggatctgctgatttgagcaaaatggaaatgaaatgtatatagaaagctcttaatttttttttttttttttttttgagacggagtttcgctctgtcgcccaggctggagtgcagtggcgggatctcggctcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccagctcttaatcttaagaagttcagtttcgcagctccccccccaccaacccccaatcttgaaagcaggaatttggattagggttttttaataaaactttctttttcttattaccatgatgttttttgagagggtacagagaactcattaaaatgttatgttataacttaagacaaaatgggaatgagaatttgcattatataaacaaagtgtatgactaagtaacctgttacatataaagtgtttgactaagtaacctgttgtccctaggagaagtagaataaatatcaacatgtggcaactaacagaatgtgttgtgatcactaaagcagcacattcattgactttacacttcattaagtaggtaacgaattttacaaattttaggacttaaccaggctgtccataatactttgcatcagtaagtaccaaaatctacgatagggcacttcggagttccttaatttaataatattgataatattttgtttacattttgatttaattgtatcatttcattatttttgtgtcctgattctaaatatatacgtcaacaagctatatggccattcaaaacaggtaaactttaaatatgtttttgacatagaaattatgtaacagtcttcatcatgagtataggagtcagatttccaattgaaaatttcatcctctaaaatacttggcatatgtatacagttgtctagttcagacaaaaaagtattgaatataaagttgattttgtaaaaccagaattggcatccttaaggaatacaaataaagggaatcttaagataatataataatgctgatttgaaatgaaaattaataaaattgttattctattttagtatgctaaattggacagatccttatttcattgaaaaattagattcttcagtatatcagtgcactgtgctaataacacaagaagattaaattatgtccatatgtgatttggtagaatttaattataaatataataaatccttcaatatgtacagcagtgaatattccaaatttatctctcatataagttgtgagcaacttaaggataggcaccatcccttaacatacctagattaagaacagtacctagaaaacagtcatcaaatgcttcctaaataaattttcaccttcaagcttatggcagcaaattaaacatagattgacccttttctaatagagacagaatagatgagactgatgacttttttttataaatgtgtaagtctgcaaatatttagtaaggatctaatttacacaaagaaatcaacctagagtgagattattttattcatttcccggaggctgtgactgaattatatttgcaacttgccctaatttttatacttaataatttgcattagtatttaaattatgtgaaggaaaaatataagtttaaaatactgaaaagtatattcacacattcatcaaatgttgattatgtgcttacagtgtgcaaggtattggggctaggaattatgtggtgttccaaggaaaccatgatacagcctctttcattacagtgtttattattaggtagaaaaagtaaaattagtataatattagataggatatatgtgtcataggagtaatataaacaatattttatgaacaatgtatgaaggtataattttgttcatttatccatttatcgctctgtacatccatccgtttattcattgttcattacttcatttaataatactttagtgaccattggaaaagggatttataaaagtgagtaaaatgttaatcattttctaaagaagttgataatctagggaaagacaaatgtgtaccaacaataacttggatataaagcataaattagaggtacaagcaaagaaaaatgaaagtacaaaggagaaaaatatttggctgcatgagagcagggactgtgtcttgtttcatcatagattttccagaacctagatcagtgtttggcacaaagtaggttcagatgagtttgtgttgactgactgtctactgaagtaattgtggaacatatcatagaagaagtagatcagaggctggatcttaaaactgggagaaatacatttcagctccgtgaaaccccagaagtgatatttgacattagaaagcacaaagtcacactctaacagtgacagtactgagtgaagtaagaattttctgcaccccttcttcttcttccactcccattaacccttgttagggtgagaaatagcagctggtgaatggtagagaagactagcaagacagaaagaggaagcccaccatgcccactaccccaggtagtaaaggacctgtccacttccatcctcttctaattgaggaagaaatcatatatgtgagttcagattgaagtattgattaatatattgagctggatattctaattttaatgtctcgatatggagcaggactttgtttccttaatgatgaccagaaaagacatgaaacttacccatattttcacccaagaacagaacagaacaacctacttgaacagatttaaagggagaaccaaaggcagataaagttgtctttattcttacacagcataagtcctgattattcatcaatttatacattttatgaatttaagaaaaaaggaaaggaagactataaagggattcatatcaggatacacatgaaggtaatgtagtcagttttttagtggaaccaaaatattacagtcatcactgaacgaaaatattacaatcattacatcattcactagattaagtgaataaattaaaaatatattaaataaaattaacaaagacatgagcttttcaaagtgtgtggtaacctggagcaataagcagtgtagttggaatgttacctcttaaggattatcaaagaggctggctgttcagtaggacagtggtatggtaaagcaagcttgctacattgcagaactccagagggcaacattctaattatctttagctatggggtctgttcccataggataactataacttagtaggttgacagagcctcccaagaaaccacagcagtgctcaattgtggcgaattacttctctatcccatcaaaatgtcgtgattggacccacaactgtgcatacatttttttggcattttcctgccagaagcatatttacatttctttaatatccagtcatatccttcccttatttaaaaataattattcagagaattccagttttttgtaatcctctcttctatgaattttagcaacacttatatacagatacttgatattctggagaaatatgcttcaagaccatgtggattaacagattttcaaatgccgttatagtatatgtatatactatatatgtataagtatgtgtagtccccaaaatgcgtactttaaaatcctcataatagatctcttacagatgaggaaaagaagatgtagaaaggttacataaagtagctaacaagtattccaaataatattgaacttcagtctgactattccaaaattgcattcttaactctgatttctatatttgttttccattctaaactgtgtattgtgatataagttcctcactaaggctctttttcagggtcttcctaatactaaagtcactcttacaatgagtattttctttacgtgtgaaatccaataggcaaaaaaaaaaacttggcaataaattttaggcattaacctcatgccaagtaattatcagaaggctgtaatgctttgaaacttcacaagtctgattttaagataatggaatgaggcttgcattgtgaactttcttgatgctttacattgcaatatgctgtatagattgacttcctaaaaataaaaaataaaaaaaaagatttgtagagcatactgggaaggtcttgccaattaaaaaccggagattggctgaaggcttgcagcaattgaattttgaatacagatggtgtcaaatcgagtgtttccatagcaacagactcttccttaataacttttagatgggagggggtacataaaagagaaaaccatcttttagcagatgtatgttttcagcatgttttcagattgattttggaagctaatttgtacttaactagtgattgttttaagtggatctaaatattactaaattctcctgaggaaacattttgagaataacagaaataaactctaggaactttataaagacatgaaaagggcacaattttacaaaacctttttttttttggtctggagccaatcaaacagtattttatattgagtatgacctatcaatagtcaaagagttcttgattcttaatgcctgttaatattgaatgtttagaatatgggtaaaatcaaggaaaaagtgctatgtatctcatggatttggaatatcttaatatactctttcttcaggttaatgattatttttaaaaaatgatgatataaatcatttcaggaaggactgcataaagaggtcattgatagagttcatatcatatagcagagttgtcgtagatttaatgtccaatcctcagttttgcatagccaacaactaaattttagtagtttacctagagatgatcaggctctgggagactgattcatgctacacaaactcacaaggcactggtttataaaccatttgaaagaagaaataataattcaaactattattttacaacaagactggcaggaaaatcaataatggtaatgtgttcggggtgtcctccccagtgaggactatccagaagaccaaatgatagattattgttcaaagtgatagaattgggagaagggtaataaagcattatgaaaggatgcttccttaagtgagaaaagctacataaactacccatctttactattctagatgaccttaaaaatattaatagaaacagagaaacagacaattcatctcagatggtacaaaaaacataatagcacatgtttgctccctggcttccttttagattccctgcaagaggttttcccccaaccaccaccatatacagatatacagctttaccttcactctcctattatctgtcacagaacaatataaaactcagatatgttagtataagttaatagttggtagctttatgttaatgacattgctacctgttacccccagattcatctgggttacttcatccccaaaaccctttcaaaacgacatttcccacaaagatttctagtattactggccattcccggacatcttgcttccaacataagaaattctgacataatagggatataagaaggccttgggaatctgtatttataacaagctccccaggctatctgaggctcagccagtttatttttgcagatagctattactatccacaatctcttttatcctattgtaattgcagaagaaaatctttctttctagtttctttgaaatttctggaatgttaggacttagagcctctaggaacttgtacataaaaagagagacttaaagagatatcaaagtagagatagagatagatacagataagtgcatagacatagaagtagacatatataatagaaacatatatgtatacatagaaatagaaatatgccatttagaactcttaagaaatatgtgcactcttaaaatatagtttaaaaatgtaaagaacttgctattaattgaaaatagcataataaacttaaatgaaataaggaccccaaacgcaaatatttctctctgacacaccacacacacacacacacacacacacacacacagacagagagagagagagagagagagagagctgtacaataacaaccaattcctgacccagataaagaaaaaatttttatttatcttctttctcattctattattattttttctagattaaattaaaatggtaattatgtgtaagaacaagcattattgccatataaacaatgcaacaaaggaatcaattgaaaattaagtgaaaataaaaggtacagcttcgttaaagacccagttcttagagcttagtctcaaactctttgtactctgcactcttttcttgatttgactcgattgattgattgattgattgattgagtcagagtctcactctgtcacccaggctagagtgtagtggctcaatctcggctcactgcaacctccacctcctgtttcgagtgattctcctgcctcagcctcctgagtagctgagactacagacatgtaccaccatgcccagctaatttttgtatttttagtagagatgggacttcaccatgttggtcaggctggtcctgaactcctgaattcaagtgatctgtctgccttgttcccccaaagagctgggattacaggtgtgagccaccacgcccagccgattttactctctttagaactgcaaaagtaggaatctagctcatatgcagacattctagaaagtttgatttcaaaagtcttctcaaaagaaagagagcaagagcaagaaagaaagcagagagagaaagcagaagataaaatggcattgtttgaacagggatggaaactgagtaagaaatttggtcactaaacactttagtgtctatcatttaagattgtaatttggttatttatcactggaaagtgattaataatctaaaatgcattttataatactaatactattaaaacattaatttttggagaaagtttattatagattgatttatacttaccactgaatattaaaatgtttaatggaagtagtttcaaatagtatttaatgatatagggaattattacaacattaatgctcaggaaaaaaagtaggatatggaattatttatgccataggatcctaattttgtaaaaaacagagaaaaccagcaaaagaaattataactggaaggaaatacatcaaagtggtttgcagttatcactcatgaaattgaggtgaacttgatttttttccttttatatccatccgtgttttaataccacagacatgctttagatctgcccgtatattgtggctttcagagggtaataaaccattgtgactcagaaatagctaagaatttttatctctcaagaacaaattttcactcccttggggtgtcattatctgttgagaatgcatgcaatagttcaagagccaaaagactctgattcagtaagtttagggtagaaaaaaattaagtacatttttaaaatagagctctggtgtttcaaaggcaatgtgcaaatatacctacttaatattattctaattttttcaggatagctgaaatataaacatctatttttagtaataacacaaatgatggaatgcttttacatatttataaatcattaaggatttgctttttgtttctactgtctggaacatataaatttgaacacaatttagaacaacattcaggaaatatgatttatttattaccttcttgacctttattttatttttaccatctacttttatgtaagtcttttttttcaatcattgtttatttctttacttttccttccacatagaattaaagggagattcgggcttagtgtccttaattcatagttccattgtggctattaaaaggtgaactgaaagcttgcaaacacgtggtaccttgtagataattttctccagtcagacagttagataaaggcctctgaggtttctggggtcattgttgaagctatgttttaaaatcctatatccttctctcattgttggttccttttcacaacacagaagttttcttttttttaatttcaacttttagatacagaaggtgcatgtgcagatttgtcacgtgggagtattgcatgatgctgaggtttggagtacggatcccatcgccatgttagtgagcatagtaactgataggtcgtttttttaacccactcccctccctcctccctctagtagtccccagggtctattgttcccgtatttatgtccatgtgtgctcagtgcttagctcccacttataagtaagtgagaacatgtgatatttggtagaacttttcatttttaagttaaaaaacaaaacaaaatgaggatgagtggaagaactattcagcacagcaggttataaaccaattaggatgatgacgccctgaatggagattttcatgaacatctcatattagctatttcagctttggtttttttaatgttcaaagtaaatagaataatgaagaggctatttaggaaggtttagactgagggaaaaaaatcctttcattaggttccaaataacggttagcttattaaacagcaagaggcagagatttagcagagaaaaaataaaaagatttaaaaaaaaacaacgagattaaaaggtcagtaataccattggaactggcagcatggcaagtttatatcagctatcttttgttttggaacacaactatgctaattctgttctgaacctcttgctaatgcctgtctcaagaaaatttaacatactttatctgtgtgtacaaaaatacctaaggacaaagctattacccaaactgtattcagattgaaagaatccatatagaaatttgcagctaacgtattagtcagtgtatgtaatttctactgcttcacagcacaactctttctaattttcaggagcaatatagcaactgcttgccagccaagagaaaaccataggagcattcttatcattggagccaacattagttctgcctacagtgactaacatagatgcgtttattgctagctggaattttccattggcactagttacatgtaataagttagtgctttcaaatggaccgtggaatataggaaaactagagtctgacgtaaccaaaaaaaaatgttgataaactcagagattatgaaagagaggagaggagtggtttttgtggaaatgatagaaaagcaaaaaaagatggcaggatttggaaaaaagaaaatcaggttagagatttaattagtaaaggagctccttttaataattatataagagtatgagtttagagtaactgcctggctaatatgtacaatcttcaagttcagtcgttttccaaaattctaacttttagcattttttttttgtaaattttaagtggaaatcttccacttttgttgactaacttggctacctgatattttactcaacctcctactttcttgttctctacttcttctgagtctttgcttccacaatgaggtagctcatattccttaagtttcctgtctggttttgcttttttttttttttttaacagctaaaataaactctacaagcatttctatcattttctttacatccaatctcttgtcagccatgtcctaatcactttggtaaagtatcagtgaccacccaagaggttcactttgcttcgtcaaaggaccacctgtcatgctttatctccagagcttctgccttgaaagtaagaataatataacctttcctgaatgtcttatttcaatttcatgcatttgatctgcctcttcagaccattcccaaggctttgcccttgttctttaccctcatggcttcagttattcatcactatatgaatgacagctctcaaactgacagctctggcctctcacctatttcatctattccatatggcaaactgtctatattacatttcatcatgagggataattataattccacattcaacaagaaattgtgggtccgtgttgatttccaacagcaacctttattttttagactatgatagagaaagggtcaactttctctcttacttatttatctcaaataactcaaagtcaagctagaaaagccaagcaagtaatatttcccaacaaagcagctttaagcaaaatgattttcagacacgacatgcagcctgtattgtggaagaagcacagtgacctaggtgtactttgctgaaaagcagtggtcacagtccattagtttcatctttttcctgcaagagagaaaagtatggcagggccaagactcctaagaccccttaaaaaattgtgaggtttttataaccctgttcatttcccatcaaaagcattcatgaagcacctgccatgtaccagatgatgcattctaggcagagggaagaacttgggcaaagtcctgtacattttatcttctaaatcttactaatcttttcttatctttccatctaccacccaccatcaggctgtgcctggactcctatgctaacatcttactctgtttttctgcatcttttttgccctcccctccaatctactctccaattagcaacatgactaatgttttcaagcccagattagacggtgtcacttccctgctttaaacctttcagtggattcccattgcactgaggttgaagaccaaaatctttaccataactcacaaggccactgggagctatgaaaattttcttttttagtttttccttttaattagtgatgcattcaataagtggagtctatcgtgaaagcatagattccaaaggcatgtgaatactcaattatgtaatttacttacagaatgtttattacttcttttttagctttgattttgtatacatcctaactcaatctcagttatataagagattataaaaaagtttgtgatgaatgcatacataaaggaacaaataattaacaaatatataaagacaaatcagtattgaatgaccaaatggctctttatttattaaagaacttagaaaaatatagtcttgcttgagaccaagttctggcaacgtatgtgtgtctttttgtttgggttaaaaagcattagttttatatgttttaaaaggataggatcttcccttggctgcaaatagtataggcaaaatgctattctgtatcttattttaaagaaaataacaatcataccttattatttgctgacagttttgcagtttacaaagcactgttcacatggattaccttattttaaattcctcaattttttttccttttactatgggaattctgtttcaggagaatttccctttaaaattaaggtgattatactattctgttcctgtatttcgtagccatatgtttcaccaaggtattgtctctctccaggtctttcttctctggatgtatagttatgattttccaggaggtaaatgaaaacagtgggagcaattgacagagtgttttttgtttcccataaacccaagcattgcatttaaggagctgctgtactattgtaagagttcctatactaattttaaaagttcatttacatattttgtagatttttaggataagtcatcagaaaaaaattaaaaataaatttacatattttgtattaagctgttttgttacttgaatggggattattggaacgaggaaagaattacttttatctccccatttttcaaatcatttactataacattcatgaattgctgaagtttaaacaatcaaaaatatctgaaaatggagcctaggaagggtaacttatgtctttcatactccttcctttttggtttttctaccagcattttagtctaaaatatattttattttcactgatcctgtgtttgtcttaataatatagtatgtatgttaaatgaaccagaattcattgatctttttttttattattcctctttttgcttttctggagaagcatttgaagaaatcagttcaggctacacttcatcaattcatttcctcatcttccccttaatacaaaagccccattttcactcttcaaaacatttgatcacatacttaattttcatagcattgactaaatgtatgtgtttattttgtttatatattgcatatttgtgatgattttcacttttacagtttaggcatgggtaggaaggacacttacatgagtacttaagttcttggttatgacttgagaaactcacaaggtagcatggaatggcacgtaaacaaggctttgatagggtgaaagggaattatcaggacaaaactgactagtggcagtgacttttgagcagagtgctgcaaactgaaaaggcagagagcattgtaggcagagagaaagcatagacacatgtgagatacatgtgaaatacttagacaaatgtgaggtgtgtggtaacattgtacatacctagggctccttcctgtgtagctgtaaagctggagtataggcatcacaacaggcagcagaagccaagaaactagaaaagtagacaaaggccacgttataaaagatcttgtaggataggtaaagagttttaatactatcctgaaagcagtgtggggtgggaggcatgacattaaggaaatttaataagtgatgaaagaccaagattttcatcttcagaagacttctctggaggtgggtggaccacttgatgtcaggagttcaagaccagcctggtcaacttgatgaaaccccatctctactaaaaatacaaaaaaatagctgggcatggtggtgcatgcctgtaatcccagctactcaggaggctgaggcaggagaatagcttgaacccaagaggcagaggtggcagtgagccaagatggtgccactgcacttcagcctggatgacagagggagactccctattaaaaaaaaaaaaaaaaaagacttctctgactagagttttaaagaaggatggggagtgcaaaaggctaacattaaatcagtggttctcatccctggctgcacgttagaatcactagggggagtttaaaaaaaatgccaatacttggactccaccccaaaccagttaaatcagagccttaatagggcccagacattcgtagtttttaaagcagccctcttgattcaaatgcacagacaaggttgtgttccgctgaactagagagaccatcaggaggcttttaactaaagcaatctagggaagagagagatgaatgatatagaggccagaagagctattaaggagaagtgactcggcatcttcttggttaaagtataaggaagaaagaagaatgaaggataatttgcatgtttctccttcagtgactaagtagaggaacagatgtgtatcagtgattaggggagaggaagaatgaagatgatgtaatccagtttggatatgttggctatttcatagagatttagtaggcgtttggctctatggatacagagttcaagagacaattcttagcttaaaacacagattttactctgattattttagagatagtaaatgaagcaatatacatacatgaactcaccagagagaatatgtaaagtgaaaacaaaaagatcaaagggagacccctagggaatagcaacatttaaggaatgggcctaagagagtgaggagtggccaaataggcagaataaaatccaagaaggaatcttccatattaatcaaaagagaaggtttcaaagagggttcgtcaattggcaggtactgaagggatatctgaaaacataaagactttagactctctaatactgtagcaactttaaggtcactgctatcacctacaaaagtaatttcagtggcaaaagccaaaacgtaatggtttagaagggtatgtgaggtgtggatgtggaaatagtgggtatagactattgcttctcaaaatgtaatcacctgaaaaatcttattttaaaatgcagattttgattcattagctctagagtggagcctgagattctgcatttctaacaagttatcaggtgatgctgatgctgctcatacacaaaccatcctttaagtagcactggtgtaagccactctcccacaaaggaggaagacatagggtttccatcaggggacgcaggtggggtgtaggaccaaaggaaataatactcttttgtcttttgtttggttggttttggttgttttcttcttaaaataaacatggttgtagacggagattgaagacataggaggggtaaaagatggaatcacttctcatagaagatggaagagactggaacattgagtacagcgagggaattaggcatgggtaggagggacacctaaatctgaagagaaggaggtaaggaagaattgaaatacagaaaagttctgtcagtaagcaatgtatggaattgtgctttttagccatagtttctgttcaagaaattgttttccatttatttttatttcttaacttgaatagttggatggtggagtatgcttgtaaaaataagagtgaggccactttgtttttcggggttaatttccgttttctgcactcatcaagtaaaagttgaagtggcaaggtgtagatatgaaattcagtgtgtgctaagggagaaaaaaatgctttttattctacatgattttaaaaatatttatattccaacaaatgcatcaaatttgatgtgcaaatttacagtgatgaatgagttttattgtgtgcattgcatgctggtgacatggtaataaatctgtggtgctagaattataatggtcccctttagcttcgctttaatgaactcttgctgaacacttttgagttgttagtactttatttgctacatttggcacttaattagttaatgactgagatgctggaccgatggatcatctaatgatatgttaggcctattatcacatctagatagtttcttttctgtgacttgtaagtgacctaagatgataaactgaaatatttttgcatagatatacatcaagcttttctcctaacttcaggctttcatcttaagcaatagtttccaacacccccaaaagagaagtcattatgtttttaaaaaaattattcattttaatgtgatcaaataatatcacatttcagcattcacctatttaattaataaaacaacttacatgtttcattatgactggatgttgatattttttcataatctattatcctccaaccagtggtaaaaacccaatcctcctctcacccagctcatctttccgtatgggaagcaatacatacttccctatgttttattaccaaaacaggagaatgagctttctttagaaggttaactcattttctctattagaatattcagcatacttttaaggaggtaatctggtctttgacagtctgttgattagaaaattaagagacctgcctaaattccatttccaactcctctccatacacattgtgactttgagcaaaacgttttgccatttccactcgtataagttctgtttagtatctttaaacttccatatcccacagatggtatttttttcttcattggaaagtggtgttagtgattcagaaaactgcttaaataatacactgctttgtgttttctgtgagagaatttttttttttttttgagacagagtctcactatgttgcctaggctggagtgcagtggcgcaatctcggctcactgcaacctctgccgcccgggttcaagcgattctcctgcctcagcctcccgagtagctgggattacaggtgcctgccactgcgcctggctaatttttgtatttttagtacagacagggtttcaccatcttggccaggttgatcttaagctcctgatctcatgatccgttcacctcggcctcccaaagtgctgggattacaggtgtgagccaccgtgcccagccgagagaacattttatctaacattctattttaaaatttttcaaatacacagaaagctgaaagaattgtacagtgagtgctcatgaacccactctctagattttgttgtatcactttacttctttctctacccgccaacccctattattttctgatgcccttcaaagtaagttggtgacatcggttccctttacccctaagttcttcaacatgcatgtcattaaccagagctcaatatttgttcacatttcttttgtttgtttgtttgtggcaaaatttgtatagactagaatgtgtaaatctcatgtgtattatgaaatgagttttgatgaatgggtatacctgtgtgacacatgcctctcttaagatacaaaaaaatagccttggcccagacaggagggaacattttttaggttggcttgagtttcctttaactgacatgtagcatgactgaatatatgaccataagattgccaagttgaaatttaccaaaggtccatccaggggaacagtatggctattgatacgtcatttgttcatctaggcactgggctgggtgagttcttcacaaaaaccttgtaaggtgagctttcagctctgacagaggcatcaagaaacgtatttcacaaactgttagagctgaaaacatctccagggatcatccaatctatcctcctttgctttatgactcaggatttaagaagccccagaaaagtccaacagtgttaccaaagtacacgattgcctatttacgcccctataattgagagctgtctaggggtcaggtacttttctcagtgccttgtgtacattatttccttttatctttctagattattaattttcttgttattatccccatataatagaggagtaaacagtgtgaaaatagcactaaactgttgatcttttccatgttccaaactaaccttaaatgttaggctaatattataaaattttaaaatttagtcatttgttctgggtctggcttccatgaacttaaccaaaatgcttggctgtttctgcattctagctttttgggatttagagaaaaagcaacttggtcatcatagtggccaggatttatttatgtgccaataactcccctctgtttttagctttttgatctgttacatctcagatactttattctctatttgtaaaacaaccacattcctccttttctatatctaagtgaaaaaaaatgcccgttcatactagctacatggttagcatatatgtttcttcctctttgtgggtttgagttgaaacttcttttgcaaagcttaactatagataggtcttccacagaaccctgtttaaatgccttgtggaagtagaagggacatatcttaatattccttataatctgtgttattatttggactttcctcagttccttatatgtctttgtatgtcaaacattgagttatgcttacattactctaggtatagttgtgtcctagctttgtacaaggttacaataatggtggtttccttgttttcagcttcattcttgatcatgcctaacattttttgatggttttagcctcggagaacagtctactgctatttctccctttttcctgatcccaacaaatagtttagaaatctttgtcttaactgcaattgggatcatttttcctttagagttgcccacagttagtcatgtccgtcactcttcactcactcaaatgacctcaaaagatttacctgcaatttaagcctttcaccttggcattttctacctggaactctggcgtactctgtgggatcagtgagatccatagtgtgcactccctagcagatcgtgaatgtttgttgataactataattcattgtttagtcttgtctatacagagaagcagtagcaccttgctttagtaggatcctttatgcttttattcattattgaattttatcttcacaataattctgtggttctgcagttgtcattatttcagtttgggagttgaggaaactgagatcgtggcaaatcaacttttcccatttaaatccactatttcatcgctaatccagggttataacccaagactaactgctagtcaaagttgctttctaaaaatcagttacacagacttctaattctcgtgctgtacagtcagtgcagaaattgcaacagaactgttctttgttctgtagcaatgtgtattcaaaaggtaatcatttcttgtgtataaataacattcctccctaagagagatgttgtgggaatttatatcagtcaagaatgtatatcgataattaaacatagctagtctaaaaaacttgaagtgaaagattggttcgtattcaatcaactgaactgtttctttctctgcaatattgtggttcttgacatgattgctgagtttccaatttgacacttctggaggttcgtaaatcaggacacatgctgggtctcagtctgtcatcctgagtcttagcattggttatttatttccctttattacccaacatctatttactgcacaaattagtcgagaagctttccatgacggacctttgtgagaaaaaaaaaatgtgtacattgggtagctcttcaattacaaacatgcacagattgtctgggtttatgtgcatatactttattattatttcacttttgtatgtcagatgaatttggtgtaaatgtaaatctaacaatatgggctctagtggccaaatacattgccataatatgtttttgatctgtcagtctcctgggtgaagtgtcgcaagtgtggtaaaattctgtagtataaattgatgctcagttatggacaattaccaggtctatatgatgtcagactaccacactgatccacttttaggataacagcttcgctctgatgatcttcagattttagatttgctttcattccttgacaaaatgaaatacatttaaaacttctaaaattgtcttttgtatatatttctgcagggtctactcttgggactactataacaatcaattgtactgctttgtttcttttattaaatagcagaatagctgcttgattcgtctgtatgtgctgatgtgtgtctgtgaatctagtccagttcactgtccaataagaatttctgaaatgttctttgtcacatcaatgtacagtcaaaatcgtattgtgtttgtagcagaatgattgcatcttttattattcacagcagccaaaatgacacatatttcacacgtgacaccttttttaaaaaagatgaattgtccaaagttgtatgtagaatatatttcacaaatcaaattccctatttaataaatggtgctgggagaactggctagccatatgcagaagagtgaatttctataaatagaatgcaactgtgtaaatagcatccaaatcaagaaacataatataatatagccagaagctcaggatcccccttcatgtcttctccagtcatgaacatttcacaagggtgactactatccttacttcaaaagttttctattactttttcctgtttttgtgtattatatgaaggaatcgaacagtcatatctacttgtctgtggctgtatttttccccccaacaatatgtttgtgagattcatccatattattgtatgtagttgtggattgttcacttttcttactgaataatattctattgataccacagtgtatttacacatgttgatatagatgagaaattgagtagtttccaacatgaggaaattgctgtcaacaattctgcaatccatagccatgctatcaacagtctagtacatggtttttggtgaatatattaataactatgcatttctgttggatatacacctgggagtggaattacaactcaaataatattcattttaaaaattttatttcgtttttagtcgacaactatattatggggtacattgtgatgtttcaatccatatatatacattgtggaataatcaaatcaggctaatagcatatctatcacctcaaatacttctcatttttgtggtgagaatatttaaaatcctcctttttagctatttggaaatatacaatatgacaatattagctatagttcctgtgctgtgcaaaagaacaccagaacttattcctcctgtctaactggaactttgtacccattgataaacgtctctcatttttccatccacccaccactgcagcttttgatcaccaccataatactctccatttctatgagttcaactttttttaaactgcacatacaaatgagattatatgatatgtgtctctctgtgccaagtttatttcacttaacctaatgtcctccaggctcatccttattattccaaatgacagaatttcctaggtttttaaaattttttttttatttttaattttttggggtacatagtaggtatatatatttacggggtacatgaggtgttttgatataggcatgtaatgtgaaacaagcacatcatggagaatgaggcatccatcctgtcaagcatttatcctttgtgctacaaacaatgtaattgtacttttagttattttttaatgtacaattaaattattattgactatagtccccctgttgcactatcaaatactaggtcttactcattctttctaactattttttgtagccgctaacaatccccacctatcccctacctccacactaccctttgtagcctctggtaaccatccttttattctgtctccatgagttcaatagttttaatttttagatcccacaaataagtgagaacatgcagtgattttcgttctgtgactggcttatttcatttaatgtaatgacctccagttccatccaagatgttgcaaatgacaggatataattcttttttattgctaaatagtaccgcatcatttatatgagccacattttctgtatccattcgcatgttgatggacagttagcttgcttccaaatcttgcctgttgtgaacagtgctacaacaatgtgagagtgcagatagctcttcaatacactccctccttttcttttgagtatgtacccagaagtgggatttctggaacatatggtcattctctttttattattttgagaaacattcatactgtctttatggaggccgttactaattcacaatactaccaatagtggataaggtttccttattctctgtatcctcatgaacacttgttatctttcaactttttgataatagccaatccaaaagatatgaggtgatatctcattgtgattttaatttgcattttttgatgattagagatgttgagtattatacatatatgtgtgtgtatatatatatatatatatatatatatatatatgctgtttgtcatcttttgagaatgtctattcatatatttgcccatttttttattagggttatttgttttcttgttattgagtagcttgagttccttgtatattttggatattagcaccttatctaatgtatgatttgcaaatatcttctcccaatctgtgggttgtctctttattccattaattgtttcctttgctgtgcaaagctttttagtttgatgcaatcttacttacctatttttgtgttgattgtgtttgggggtcatatgcaagaaaccactgcccagaccaatgtcatggagctcttctcttatgtttttgtagtttttagtttcaggtattacatttaaggctttaatccattttgagttgattcttgtataaggggtgagataagggtccagttttattctgtatgtgaacattcagttttcccaataccatttattgaagagactgtcctctccctattgtgtgttcttgctacctttgtcaaaaatcaattgatcaaaggtgtgtaggtttattttagtcctctttgtcttattccattggtctgtttttatgtacttgccatgctgttttgattattatagctttgtaatacattttgaaatccagtagtgacatacttccaattttattctttttagtaaagacagctttggctatccagggtcttttgtggttccatgcaaattttaggattttttaaaaaaaattctataaagaacaatatgcagattttgttagtattgtgtcgaatctttagattgctttatgtttaacaatattaatttttccaatttatgaacacagaaatctttccatttatttgtgtcatcttcaatttctttcgtcagtgtcttatagtttcaacacgcagatctttcactttcttggttaaattcactccaaatattttttcatgctattataagtgagattgtttccttaatttctattttagacagtttgttgttattgtacaaacaataacaattgttatcgctactgatttttgtaagttgattttgtaccctgcaactttactaaacttgtgtatgaattctaacagttttcagtggagtccttaggatttgctgtataagattatgtcatcagcaagaaggggcaattttacttcatccttttcagtttggttgccttttatttctttctcctgcctaattgctctggctaggactcccagtactaagttaaacaagggtggggagagtgggcatctttgtcttgctcctgatcttagagaaaagccttctacgttttactgttgtgcatgatgttagctgtgggcttgtaatttatggcttttattcttttggagaacatttcttctatacctaatttgctaagagtttttctcataaaaggatgttgaattttgtcaaatgctctttctgagtttattaaaatgatcatacggtttttgtacttcattctgttatatgttgaatcacatttattaatttgcatatattgaaacaaccttctatcccagggataaatccctcttggtcatggtgaataatccttctaataaactattaaatatggttcactagtatttcattgagaatttttgcatctaatttcattcgtgatattggcctatagttttctttccttgtagtgtctttgcctggctttgggatcagggtattgctggccttgtaaaataaatttggacgaatcccttcctctttagttttccaaaagagtttgagaaagatttgtgttaggtcttctttaaatgtttgtagaattctcccatgaagccatctggtcttgagctttcctttgatgtgagaacttttaaatactgatgcaatctccttaactctttccttagctgttactggtcttttcagatttccaattttcattattcagttttggtagattatgtatttctaagaattcatccatttctgttaggatgtccaatttcttggtatataattgttcatcgtagtctcttaggatcctttgtatttctgtgttatcagtcataatgtcttctctttgatttctgatttgatttatttgagcctgctctcttcattcttagtctagctaaggatttgtcaattgtgtttagcttttcaaaaaaccaacttttagttttattgactttttttctattgtttctctagtctctatttcatttatttctgctctgatctttgttattttcttctttctgctaactttgggcttaattcattcttctttttgtagtttcctgaggtataatgttaggtatttcatttgagatatttcttcttttttgatgtaggaatttattgatataaacttccctcttagcactgcttttgctacccccagaagtttttctatgttgtgttttcatttctgtttgtctcaagacttttaaaaaatttcctcttgaatttcttcttttgacccaataattgtttaggagcatattgtttagtttccacatatttcttaattttatatgatttctcatgtaattgatttctaattttatattgtggtcagaaaagatacacgatgggttttcttaaatttgttgagacttgtctgtggcctaacatatgatctatcctggagaatgttacatgtgtacttgagaagaatctgtattttcctactgttcagggcacaatgttctgtatatgtctgttaggtccatttggtctaaaatgtcattcaagtccaatgttttcttatgaatttttctgtctattgcttaaagtggaatattgaaattgcctgctattattatgttataggctatgtttcccttcagatcccttaatgtttgctttatatatttaggtgctctgatttgggatgcttatatacttgttatgtcctcttgatgaaataacctttatcaatatataatgatgttctttgtcactttgaacagatttgacctaaagattattttgtctgaagtaagtgtaactaccctgctctctttttgttctcatgtacatggagtatcttttttcatccctttactttcagtctatgcatgtcctttaaggtgaaatgagccacttgtaggcagcacatatttgggtcttgttttttgttgttgtcgttaatccactcaaccactctatgccttttgattggagagtttaatctatttacattcaaaataatgatggatgggtaaggacttactagtgtcattttgttcattgtttcctggttgtcttacagattctttgttcctttcttcctctattgctgtcttcctttgtgttttgatggttttgtgtagtagtatactttgggtcttttgtttttatcattcatgtatgtattataagtttgtgctttgtggatactccgaggcttacataaaacattttataagctgataataacttaaatttgattgtgtgcatatactcaacactttgactctccctcctcccacattttatgtttctaacatcacaacttacttttttttttaattatactttaagttctagggtacatgtgcacaacttgcaggtttgttacatatctatacatgtgccgtgttggtatgctccacccattaacttgtcatttacattaggtatatctcccaatgctatccctcccccgtcccctcaccccacgacaggccccggtgtgtgatgttccccttcctgcgtccaggtgttctcattgttcaattcccacctatgagtgagaacatgcggtgtttggttttctgtccttgtgatagtttgctgagaaagatgatttccagcttcatccatgtccctacaaaggatgtgaactcatccttttttatggttgcatagtattccatggtgtatatgtgccacattttcttaatccagtctatcattgatggacatttggattggttccaggtctttgctattgtgaatagtgcagcaataaacatacctgtgcatgtatctttacagcagcaggatttataatcctttgggtatatacccagtaatgggatagctgggtcaaatggtatttctagttctagatccctgaggaatcgccacactgacttccacaatggttgaactagtttacagtctcactaacagtgtaaagtgttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatatccttcgcccactttttgatggggttgtttgttttttcttgtaagtttgtttgagttctttgtagattctggatattagccctttgtcagatgagtagattgcaaaaattttctcccattctgtaggctgcctgttcactctgatggtagtttcttttgctgtgcagaagctctttagtttcattagatcccatttgtccgttttggcttttgttgccattgcttttggtgttttagacatgaagtccttgcccatgcctacgtcctgaatggtattgcctaggttttcttctagggtttttatggttttaggtctaacattaagtcttcaatccatcttgaattaatttttgtatatggtataaggaagggatccagtttcagctctctacatatggctagccagttttcccagcaccatttattaaatagggaatcctttccccatttcttgtttttgtcaggtttgtcaaagatcagatggttgtagatgtgtggtattatttctgagagctctgttctgttccattggtgtatatctctgttttggtaccagtaccatgctgttttggttaccgtagccttgtagtatagtttgaagtcaggtagcgtgatgcctccagctttgttcttttggctcaggattgtcttggcaatgtgggctcttttttggttccatatgaactttaaagtagttttttccaattctgtgaagaaagtcattggtagcttgatggggatggcattgaatctataaatttccttgggcagtatggccattttcacgatattgattcttcctatccatgagcatggaatgttcttccatttgtttgtgtcctcttttatttccttgagcagtggtttgtagttctccttgaagaggtccttcacatcccttgtaagttgtatttgtaggtattttattctctttgaagcaattgtgaatgagagttcactcatgatttggctctctgtttgtctgttattggtgtataagaatgcttgtgatttttgcacattgattttatatcctgagactttgctgaagttgcttatcagcttaaggagattttgggctgagacgatggggttttctaaatatacaatcatgtcgtctgcaaacagggacaatttgacttcctcttttcctaattgaataccctttatttctttttcctgcctgatcgccctggccagaacttccaacactatgttgaataggagtggtgagagagggcatccctgtcttgtgccagttttcaaagggaatgcttccagttttgcccattcagtatgatattggctgtgggtttgtcataaatagctcttactattttgagatacgtcccatcaatacctaatttatcgagagtttttagcatgaagggctgttgaatttggtcaagggccttttctgcatctattgagataaccatgtggtttttgtcgttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcgatgttcatcagggatatttgtctaaaattctctttttttgttgtgtctctgccaggctttggtatcaggatgatgctggcctcataaaatgagttagggaggattccctctttttctattgattggaatagttttagaaggaatgataccagttcctctttgcacctctggtagaattcggctgtgaatccgtctggtcctggactttttttggtttgtaggctattaattattgcctcaatttcagagcctgttattggtctattcagggattcaacttcttcctggtttagtcttgggaaggtgtatgtgtgcaggaatttatccatttcttctagattttctagtttatttgcgtagaggtgtttatagtattctctgatggtagtttgtatttctgtggtgtcggtggtgatatcccctttatcattttttattgcatctatttgattcttctctcttttcttctttattagtcttactagcggtctatcaattctgttgatcttttcaaaaaactggctcctggattcattgatttttttgaagggttttttgtgtctggatcttgtaggtatgcttcattgtttcttattatttttttcttttgtcttctctggctgtgtattttcaaataggctgtctgcctacaagatccagaaaatagcctcaaaagggtcaatctaagagttattggccttaaacaggaggtagagaaagagatagggatagaaagttgatacaaagggacaatatcagagaacttcagaaacagagaaagataccaacattcaagtacgacaaagttatagaacaccaagcagaattatctcagagactacctcaaggcatgcaataatcaaactcccacaggtcaaggataaagaaagaatcctaaaagcagcaagagaaaggaaacaaataacatgcagtggagcttcaatacatctggcagcagatttttcggtggaaatcttaggccccgggcatatccagagatgctgtctgagggccagtcattggagtcaaaaaccttagcagtttacctcatgttctattctattgtggctaagctagcactcacaccacaatataaagtgctccctgctcttccttgcccttttaaaaggcagaggatcctctccctgtggccctcaccaccatgagggttctgcttggcctccactggtgttcacttaaagcccaagggctcttccatcagcttgtggtgaatgctgagagaactgggacccatattttagggccttgggctcccctctggcccaaggcaggaccaaaaatgctgtccaagaacctaggccaggactcagaaatcccagaagcctgcctgcttctctgcctttctgtggctgagctggtacctaaggggcaagacaaagtcccctttacttttctgtctacttttctcaaacagaaggggtctttcaccataaccaccacagctgggaatttgctgggtgacctatgaagccagcacatctcagaggccaagtcccacagtgtactccctgggtattgcaactggttattcaacgttcaaggcctctttagttagtagctgatgaatcctgataggactgagtccttccctttaaggtagcagattcccttttggcccagggtgtgtctagaaatgctatccaggaactagggcctggaatgggggcctcatgactctgcccatgccccatcctactgtggctgagctggtatccaagatgcaagacaaagtcttctttacttttcgctctcttctccttaacgagaagtaaggagtcacttctgttgctgcaagcttcactgctgggagtaggggaggtatggtgcaaccactcccttagccatgccagctggtgtctccctaggtcatgtgggagaccctaatccactggcttcaatatatagagggacgtttctaaattatttatctgtaatttgattaagaagatagacacaggcaataggatatgccaacagattctctctaacctatagttattttaagaaagttagggaaagagaggtcattgattagttttggcttactgaattatttgaccctcccatatcttttaatttatggattttatataaggcacagatattctactagtaaacatgacattaaagatgttttatacaaatgaatgtggttgatacaaaggcattaaataagaaacaaaggaaattcagaggacatttgttcgcctggaatagagatcattagcataagcataagaggaaaataaggaaggaaatgggaaagtcttgagtccattttcaaattatgaaaacttgaaatgcaacaaacaaatagtggttacttaagaagaaagactgaagatgctgggcaaaggttaactttagaaatggcatttttatatcattataaagagaaagtggggataatggaaataatctacatgtacaactcatttgacagacatttattgaaggtattccaaatgccaaacactagtttgtgcactaaggatgtttttaatttttactttttactttatttttattttctagcttcttccgctttgccagagaaggatttttttaaatggataaaatactaacttaggctagcttctttcagaaacagacctttaaacaatgattaatggtgaaagtggtttggttgtaatgtgatcccaggaagtaccagtaggagagtgggacaatgagataataaatgaaagaagccaataattaagccagttatggaactagttattgctttgggccactggggtttgatcctgatgaaggagctctgggagatagtaaacaaacaaacaaacaaaaaacatgcctcaaagttgtcaaccacaagggggtaaaggcaaggaaccagggctaactattccaactcttatccatcattggctaaatgcttcctggtacataaactttccagcacttctggccagcgcacctagcaagctgaggaaaatctctcaggtttgcagtagggcaaatgcttgtactaggacactgctggcatatacttgaaggatgagtgccaacggcagatagatgggccctgacagcatcttctacagattctgtccttgcctttgaggcaaggacactgtctagagtcagagacagaaatgtaaaatgtaaaaatgtaaatcatagtagcacacagtacaagttttaaaatcttaacaaagtgttatgggagaaccacggtgagagaaaatgactgcacatatgagagcaggggaagtctttatatgtgatgatgacatttgagtgggtgttccgttatcaaagatctacttaaaagggaaaaagagtagaattattttaaaccatggatgtaaccaggcgtggccaccctatatgtgaatgtcctgggataattttgtccccagatgtctctctttttgagtgtcattttcatttatgtattcataatataaagaaattgaatagaaagaggtaaacattggtggcaaaaatcccttcctacccataaggctcacagaataatgttgtctaaatgccataacatttttggtaagttttggttctatgggctttggaaattttttatgtaggaactcctccaaggtgatataagcattcagtgtatttatctagataccctagttaaagctactttaagcaggatcaaagtcctcttttaaacttttgtatttgaaagctattcccatgtacaattcccatgattcttgtacaattcctaggagacctttgtttacatcaaaagagtttgtctctctctataagttagaacttgtacattgtagtaatggaaaatccatttcaaagtagcttagacttactcagacaaaatgtattgatcagtgtcattaaacagttgaaagatagacgaggcttgattcaggaattaaatagcatgaccagattctagttttccttctccattgcatggctctgctccccagtatttgttccgtttaattcctcttaattgttctaagatggatatcaggatactgcagaactacgtgctttctcatccatcttaaacaagaagcaatgggttttctcttttagaatcacgaacaacaacaacaacaacaaaaatcctagagttgtttcattggttctgattgaccttacttggaaccataagtccatctttgaattaaccactaaagccagggagatgagttaaaactaagtacacaccatccacagagcaaagagaggtctattgtgggaaaactgcacaaatggaaaaataacaggggaaacacaggagaaggaggtagttagttaatgttcaatacacgcaccttctcagggacttttcttccatctggcatcatctttgtcttttgaccattttccccaatcaatacctatattcatactcaagttttccatatttgggaaaaaacttctcttgacaccaaactcccctctgacttccttcttataatgatctatggttggatagtctacaatttactgtccttactttttcataggtattttttaatctcctacagtaagatttctaccactgcactgaaatcattttgtgtatggtcttcagggaattccatgtggccaaagccaatggatacttttggcatgggctttggaggtctaacttcttgaatccaagtgtcggctctaacaatcactatctatgtgaccttagaccagttatttaacgctgtctttatttcctcatttgttaaatgaggataattgcagcaatagaaaaagaacgtaaacaattatacttataggattgtatgatgattaagtgattaatgcaaggaaagaacaacacagagcttcagacagtgtagatattcaaataaatgttagttatgatttttattatgtcttgtgacatctatgagatttgaaagtgttaatcactcttgtgtttttgaaaatctttcttttccatgttctataaaagtacactttcttgatattcctcctccttctctagtctttcattcatcttatttgctctttgtgttttatttattctttttacgttgtattttccaggagtccattcccagcccggtgttgggctcagtctatgtgccatataaatgagaatgcacttgcatttgaggctttgctttttatttctctgtagtgacggccaatcccagatttctgtctctcccaaaatacacagctatgctatagatccttcagtcctcctgactaaaatgttagttttatgtgtgtgttcctcacaacctcccagtgaataggtccaaaactgaactcattatcttctccatgctcactctgcattctttggataggcagtgaatagcaccactatctaacaggcacctaaaccagaagccaggtaatctgtcttaaacccttttgttttccaagttcttatcataatggctggtgtctaacagatggtaaataaaatagagactagctggctacatggatggatgtgtggggatgcacagagggatagatggattattgagtgagtctctagcctataaatatttttaattaactaataaattatgataatgtacagttgaaggtcaagggtgaaaaagcataccctcagtgggatgcacaccccaaggagccattttaacttgctacataacacacatatgaccacttttttgctgaaagccttctattattgagcaagcattcaaatcccatgtttgcctgaaataatggttcaggttataaaagtttccttctttttccaggattaaaattatcttcctacataataggaagaactgctttatcttttcctaatatctagagatggccttttaaaaatatagactgttttccctattgaaatgaactgtaggatgtacaaaatatttactggcatgaatcaaaagagcttgctatgtttatgtgaaaaccactaggcattctaaaaaatattgctagcatagtaaaatgttagtaattaagactaacgaaagcgaaggcaaattggaatcagagactatttttaaggaatgtcaactgtattattttcaaatacacatggtacataacagtaggatatgagaaaaagtcccaagtatgtgtactaaagtagcctgctatgataagttgaaaaagggtttgtaattggaatatccacagaatatttcagaacacttaaagacattttcatttacactttatacagctttcttataagagcatttacaccatttattttataaaccaaagattaattagaagactaaacaattacaaggcctcaactacgaaagctgttccactacctagtggaacaacaacaatgagacacacaaaacaatggcgttcaaagattagagagagacttacggttaaacagaggttgacatgttaactgaagttgcaatataatatgtcgactagttttgcaatacatagcaaacacccaaacagaaataaacctgataaaaaaacagtagtctataatgtgtgccacttactgagttttaattattctggggactatatttttgatttcatgttacaatcactagttttgtggggtctttctagtcctgatgcttatttacaaaatatctgaagtatttctttctatgtatttatttttgagatggagttttgctctgtcacccaggctggagtgcagcggcatgatctcggctcactgcaacctctgcctcccgggttcaagtgattctcctgcctcagcctcctgagtagctgggattacaggcgtgtgctaatttttgtatttttagtagagactgggtttcagcatgtcggtcaggctggtctcgaactcctgacctcatgatccacccgctttggcctcccagagacctgggattacaggcgtgagccaccgcacctggccatctcaagtatttctttaacttataacttcacataactttgtggaggcaacagggttaattaaaaaggactttacttacataacaaaataagaagcatagttttatattcctgtgccatatacattttgtttgtccatctgtagccattctttgaccttctctcccttgctctttattctgggaggctgacctctgtcatcattgggctcccatgccctttggcttccagttggtttaggcacccaagagccctagaaggaaattgaagacaggaggtaaagtgaggtcaagatatttattctcctaattccctccctttgaggttgccacaggctgactatgtcctttgacaaaaggttattgctcttctcagggtggtttctcattccaattctctgcttttggccacttttccctcccctcatcccttgggcctagatgtagtaacagctctactgttgcaaggttcttgtattatctgtgatggtttcttataccctgcttatcttgtgatttgttgctttgtagataaacctctcagattatctaggcaagatcatagaagaacacgtatgtccagctaagatattccagaagacagtagggaaacattgaagggttttataagagggagtgcagtgatcagatttatgttagttttaatctttaattggggtagaatttacattctaaaacagagatttgggtctgggaggatgatatagagcctcttatggatgtgagggcaaaaaatgatagaggtttgcagtgccaatagaaagaggaaagaagttatatatgagagaaatttgtaactaattatatgaggtgttgggtgacgcttaggaaagaatctagaatgtctatcaggtttcatgcttaagggataaagtagatggcagttttattacttgttttctgtattatttttatttcataaaaccagcttagagaagttgcatagaaaaaataatgtagtcctgtttattttaatatttgaaaagaacatatttcagagtagaatctatatagtacctccctcttggacttccaatgataccagtgatagcctcaatataagccagtcttacaaaatgcacccagcgtgaattcttaggtattgttaaaagaagttggccaggcgcggtggctcacgcctgtaatcccagcactttgggaggccgaggcaggtggatcacctgaggtcaggagtttgagaccagcccggccaacatggtgaaaccctgtctctattaaaaatacaaaaaaaaaaaattagctgggcatgatggcacgtgcctgtagttcctgctactcgggaggctgagacaggaggatagcttgaacccgggaggcggaggttgcagtgagcggagattgcaccattgcactccagcctgggttacaagagcaaaactccatcaaaaaaaaaaaagaaagaaaaagaagaagtttctaatacacttatcttcccttgggttcactcagaagacccttggaaaaggttttaagagcaagtgatttatttggggggtaaattaatcagtagaagagtggaaaaatgagacaggtgaggcaaggcagccagtaaagagtggtgcattatcaagccagctgctgttgtgggtcactggagctttatcccttgggaaactctggaacccttgtaaaatacatgcctcagagttatttcccctagcatcaagggagctagtgtaacaatatcccaattcctacaattagtcattatatacaggctgcctctgggagctggaggggaggcatcagttgcctggtatgtctagcctgtcacatggatggcaaagcaaactcctgtggcaacagaaagccttcaggcaatgaaatgctggcactgggaaatcaggctgatgggtgctgaagtggcaaggatgaggggatatggatattctgctgtagtgcttttctaacagatgattcatatttggttctagggatcaagaattgagttaaaattttatatatatgttgatgttctatgtcaccttcaggaaaataatttaacagaaactaatatttgccatcaaaaaagcaaagaatcctgttgttcatcatcctagccataacacaatgaataattttttaaataagcaacataaatgtgagataacgtttggaagttacatttaaaatgtctcctccagactagcatttactactatatatttatttttccttttattctagttgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaaggttagtatcaaagatacctttttaaaataaaatactggttacatttgataaaattataccatagattgtaatttaatgatgtttaatgtaaagttattaacagaaaatcacgttaaagctgaaatgaacagtagactttgtatatttattttcttagagacagagtctcactgtcacccaggctaaagtgcagtggcacaatcatagctcactgagccttgaactctggggctcaagcagtcctcctgcctcagcctccctagtagctgggactactagccaggcgtgtaccaccacgcctggctaattttttaaaaatttttgttttctgtagagatgggttcttgaactcttggcctcaagcaattctccttccttggcctcccaaagcactaggattacaggcatgagttagcatgcctagccagtagacttttgagtcaaggtagagaatagaggaaaattgacagctaatgtcaatgttaaagttaattttgtttagtaatctggatatagttggctggttttctgttgcaccatctttaagatcacttcaaaattggtatacgtatttatgtagttgcatgaagtcaaccattcgggcttaattccttcctagaaaaagtaacaggtctactctttcatatcttatttggaggccctggatcaagaaatgggggtgagtgggtatcaggattggggaggaataaggagtactctcactttctccccccattctcttacctccagcccagctcattcttctcttctttctctttcctctgaaatttcctcaaatatctgtctgcttagtagtctataattcctcaggataaaagaaaaaggaaaaggaagaaaattgcttaataactatgttttatcaagcagcatgcatagtgctttgcatgcgtttaatcccttcaaacttagtatttactagtcagtttgaaaagcccttaaatgttaaacaatggttaagctttagggtattttgagcagggaagtaacatggtaggaggttgatcagattgggcacttgatcaaaaccctctatagatattttatctgacagaaaaggccttttgctaaaccagtatctgattctcaaattggttatgtcatctaagaaggaaaccgtatcattttcttggatgaaatggcttccatttccaaattagtcaggttaggctatgctaagctatagtaagaaatgaactctgaaatctcaatagcttaacacaataaagactgctttcttggttatatcatagtccagtagaggttgacaagccattcttaggagctgtcccccaacatggtcacttggaaacccagacttttccaattttgtgacacttgtcattttcaacacactgccaaaagccactgcagaaaaggaagacagaatgtggtcagtcaatccatggtgttttatggccaggcctggaaattatgtatatcacttccaccacatcccatcacacagaacttgttctcgattgaatttcaggaagagttaatggaattagtgagcttttagccaatctctgtcatagccattttatcgaagggacctgagctgctatgaggacaaggttttagtttatatgatgaggatgttagaaagccacatagaattttacagtcttatcattagctctgttggagtcaaaatctaggtgaataaaaattctttcaagagacacatgttaccactaatggttttttcaatggatgagcatagatgaattaggaatctccaatggtcattttcctaattcctggtctgactatgtaatatatagaatcatgtggttattcttgaaagctctagtcatattcgtgaggtagtcagcatgttatgctacttctttttcttctctataagtttcggatactatgaatctattggatcacaaaccaaagtagttaactggtaagaaggtataagcagaaaatacgaagtttggactggatccttgagttagatgagaagaaggagagatgagaggcatacagtgatagatttgactagggcaagaggactctggtagttagcaaatgagaaataaatttaacctaagaaaatcctaaagtgatggtaagaatggttagggtttaattgctcttagaagagcaagtagctttaaataagagacaaaaatatctgcagaaggaaatatgaaagtagaaaacaaaacaattgcattgtcaaaacatgtaagatgttttaatcacctaaaataaaaccagaattgtattataattgctatcctttgtcaaacttttgaaattaaaaaaaaaaaacgctttggaatggtctaaaactacatcataaaaatggctcagccactatctatagagattgacattttttgtttgtgctctgtgtttaggaatttaatgatgtgtattgctgcagattcaatgtaagttcccgatacagataaagatggccaaagctgtaattttttcatccatttcttgaatgatgtatgctaaaattaaagtaatcctaatgttaataataacttttagtgaatgcttgctgtgtgtcaaaaagtatgctagtcactttatatatattggtttatttcatcctttcaaaaacactctttgaaaagtactcttattattcttagtttgcagagaagaaaactgaaggctagagaagttcagaatcttcttttgaaagtagtagagttgtgatgcgaatgcatagcaattactcttgtagatgacctcacaggcttcctcttccaattgtctacgtggctaaaacaaagcaagaaaaccccataagaatctgaaaaagactcatgtaattattaattgacaaataagattatattacattactgataaaccaacaggtagaaaatgaaagcaatgaaatagtatactgcgaaaaaaaatttcatattatattctttgatgaaaaaataaaacaataattgcaaactgcatttcatttttaatgaaacgacaatgtttaattcttctaaaaggtagggagcaaataaaatggttatctggtctttacatcgaatgtgtcatcactactaagtgatattagctggcttattacttaaaattttcttttaggaaaaaagtgtgaaaatagacaggaggagacattaaatggctaaagcaacacccccttgctccgtaagttctttctgagtctgtgtgcctaagattaacaagagagcctgtgagcctcacaaggcaatcacaaagctatgtctacagccttggagagctgtgattacagcagccagcctcctttgcagcacctcagtgatgactacactaactctcactactgagcaacaatgaaatgtttcaaacccaaccaccaacactgttataactcttaaaatttgagccagtcaccatacctgaacgtaaaaagaaaattaccaaaaatgcttgataccaaaaagcaattaatgattcataattgctaatctttattgacagtctcttctagttcttatctacatatattttaattgtctacataatgtaaattaaattttaaattctgatttgtaaacttaatattgcataaatatttatcaatgttgttaaacatcttttaataattattttaacttctttatattatttcattaatttccatctttatgtccttgctggtctgacatttagaaaaaactcctccttttatttagaaaaaaagaatggtgaggccgggcgcggtggctcatacctgtaatcccagcactttgggaggccgaggcaggcagatcacgagatcaggagtttgagaccggcctgaccaacatggtgaaaccctgtctctactaaaaatacaaaaactagcctggcgtggtgctgcatgcctgtagtcccagctacttgggaggctgaggcaggggaatcgcttgaacccgggaggcggaggttgcagtgagccaagatcacgccactgcactccagcctgggtgacagagcaagactctgtctcaaaaatacataaataaggagaataaatggggacaataacaacctattcacagaacagaaataaaaccggagatgtcatgtggaaaaagcttatcttgaaagcgtggtcagagtggaaagaaacagcaacaggagagtcttgatttggtgaaaaaacagaatgcagatggcatagagtatcaacaattaattagcaggccatcaagagacggccataacatattggtaattgttttctttcacccttaattttttctaaaacaaaaacatgaagttagaaagtagttaattttgttagccacatggcttcatggtttaattttatcttctctatgggcctggtacaacaataaagttcttttgagatagaaagacagatgttaggcaaaaacatacaagattttcattctaatcaaaatctttgccaataggctatgacagaatcctatgagagatgatgccatttagaactttcacaagaggcaaaaatagtatgccattggcacctaaaactgccaacagtgatcatcataggatttatttcatttggcggattcttggttgagttcataacctgttccctaggcttttaagattggtccaaacttggcaatggattctttggaaaaattatttcttgatcgttttaaactttcttttccagtgtcaagagagattttcccaggctccgagttttcatttattttttcccctgtcagtttttgaaagagaaatcccctttttgtcggctttgtgattgcttttgtgtcaaattcagcgtaaaagcttttcaaacgtgacagcattagctgttttgtgcttggctgagctaagagtacatgaattcaatagagaagtgaaatcttgtttgagcctggctgatttggctatataatattgaaaactatctgaagcaagaaattcaatacttttcaaattattgaataaacatttctaaggctgcaaaatctctgtgtttttgaaggcattctttaggaaacttgaaacacagacattctataatcacataattaattttaaaagttgaacttattgtatgtagtaactaaggcagctatttgagtgtctcaaattattttactaaaaagggagacatttttcaaatatggaagtagtgccttacatttttagttatctgtggaaggatcgatggcatcatatatctcatccaccataaaaatatgtacggtagtggaaactgaatttttcttttatatattttgtgtattttttggagttgtacaaaattaaatcagcaaattgacccacactagtagtttgaggtttgggtttctggtacaataatgaaaagcattattagaaatcttcttgccaggacctaccatttcttcatgtattttctttattcccttttgttctcccctaaagcttctatgtgattaaagagaaaagatcaataacccaatagtacttttccttctaaagtatgcatgaaactcttaaagttctcaaagcatacaaacagagtgctctctacattgctgatagaacacaggtagtaatgggctagtttccccaggtaactattatattatataaatatttaatgcagagtcaccaagccttgaataactttatgctttgattgtaccatattttctctagtttgcttttcacaatttaacttatcccgtgcttgaaaatataatgtggtaactgtgtaaatctgctcctcaaaaaattttcgaaatcatcttttcttttttcttttctttctttttttcctttttttgagatggagtctcactctgtcacccaggctggagtgcagtggcatgatcttggcttagtgcaacctccacctcctgtgatcaagtgagtctctcagcatcccaagtagatggaactacaggcacattccaccacgcccaactatttctcgtgtttttagtagagacagggtttcactatgttggccaggctggtctcaaactcctgacctcgagtgttccgcccacttcagcctcccaaagtgctgggatacaggcgtgagccaacatgcctggccccacatcgccttttctgaaccctgggaattaaccaaaggctggcaacaatttttgaaatgctgactctcaataaaaatggcaaagtttgaggttttttaagttggcctttcccgtcactttctcccagctccacagtagccttgaaaatcagtagccttgcaaccataatagctgtgaaaactagcagccttttagccaccagagagtgtagaccaggattggaattcttcaaaaaggccaattttattccaagaaccttgccactgtttgacctatcttgcagctccctggaataaacctatatacatggccttgcctttatttggcccgacttagagataactttctaggaaaagccctagctccagggtgttggtccaaaccaattagcagcaattctttaacataacaggttcctaaggctgtgatgctagttgagataaacataggtctggagaaaaacttccagtgaagctctggagaatgaggtgtccataggggattttggcaacctctgacatgttcttgcgggatctagaagcccatgtgcttgtcttaacaaatagagagtatcaataaagagatagaaattgtaaataagaactcagtggaatatctggagttggaaagcacaataactaaaattaaattttcacttgacgtcagattcaagctgcaaaagaaagaatcagcaaacttgaaaataggtaaatgggataatccaatccaaagaaaagaaagaaaaaatattaaggaaatacagaaagcaaaaactgactgaactgaaagaagaattaggtaattcaacaaaaatagttggagacttcaacatctcacttttaataacaggtaaaagaactaggcaaattaacaaggaaatagacacttgaaaaagactataaagactataaacttacaagacctaacagatatctatacagcgtttcatccaataatagcagaatactcattcttttcaactgtacacgaaatattctctagggtaggccatatgctaggtcataaaataagtctcactacattcaaagggattaaaatcatacaatgcagattttatgaccataatggagtacaattaaaaatcagtaacagatgtaaatttgggagttcataaatatgagaaaattatacaacacactcttaaatagccaatgggacaaagaagaaataagaaaatacaaaaatatcttgagataaatggaaataaaaatacaatataccaaaacttatgggaggaggctgaagcagtgcttagagtaaaatgtataactataaatacctatatttaaaaaggaaaaagatctgaaatcagtagcctaagcttctaccttaagaaactagaaaaagaagagaaaagtaaatctacagtaagcagcaggaagtaataacaattagtgtgaaaaaaatcagatagaggaagaaaatataatagaaaaaatcaacaaaaccaaaatctagaaatttagttatttgaaaaggtcaacaaaattgacaaagttttagctgattggttaggaaagaaatggtcaaattactaatattagagaaaaagagggtgcattactaccaacattacagaaataaaaagaagtaaaagaggatattatgaacaactaaacaaatagataacctggatagacctataacaagaaattgaattggtattaaaaacttctcccaatgaaaggctcaggcccagaagtcttcccccgatgaattctaccaaacatataaacaactcttccaaaaaatagaagagaaaggaacacttcctaaccagacaaagatatcacaagaaaacaagctacagagcaatatgccttatgaatatagacttgaaacgcctcaaaaaattatcaaacctaatacaacaacatattaacatgattgctaccataaccaggtaagatttatcacaggaatgtaaggttggtttaacatccaaaatttaatcaatgtattataccatatcaatagaataaaggacaaaaatcgtatggtcatcacaataaatatagaaaattcatgtgacaaagtacaaaaccctttcaagcttgaaaaataaagaacacttaacaaatgaagaatagaaggtattggccaggtgtggtggctcacgcctgtaatcccagcactttgggaggccgaggcagttggatcacgaggtcaggagattgagaccatcctggctaacacggtaaaaccccgtctctgctaaaaatacaaaaaattagctgggcacggtggcgggcgcctgtagtcccagctactcaggaggctgaggcaggagaatggcgcgaaccctggaggcagagtttgcagtgagccgagacagcagcactgcagtccggcctgggcgaaagagcgagactccgtctaaaaaaaaaaaaaaaaagaaggttttgtggattgaatagtgtcccccgctcccaaaagacatactaaaagcctgagcccaggtatctgcaaatgtgaccttatgtagaaatagagtctttgcagatgcagtcaagttaagatggtatttttataagaagaggaaaagaggcatacacagagagaagaatgccacataaaggcactgaccacgggaaaaacaccatgtgatgttacagttagagattaaagtgctacagttgcaagacaagtaaaactaatgattaacggccatcattagaagcaaggaagaggcaaggaaaaattctcccctacaggtttcagcaggagtatgggcctgctggaatcttgattttggatctagcctccagaagtctgagacaatgagttttgtctacccagctacgcaaattgtgacacttaattacagaagcccgaggaaacgaatacagaagaggatttcctcaacctgataaaaggcagctacaaaaattccacagctaatgttattgtgaaacactgaatgctttcccctaagatcaggaaatagtgaaggatgcctggtctcaccacttctattcagtattgtactggaagttcaggccagggaaattaggcaagaaaaataaataaaagacatccagattagaaaggaataagtaaaattatctctacttgcagacaacatgaccttgtaattagaaaattttgaagaatctatgaaaaaatattagaaataataaaataattcagcaaatttgtaggatacaagatcaatatacaaaatgaattattttatacattaaaaatgaataatctaaaagtgaaattaagaaaatatttacaatggcatcaaaaaatgttaaaaacttaggaataaaagagatgcaaggcttgtatactgaagaatacaaagcagtgttgaaagaaattaaagataaaaaaatagaaaaatatcacatgttctcagatcaaaagacttaatattattaagatatcaatatccccccaattgatctacagactctatggaatcattatcaaaatcacaactggcttttttttttttttcagaaattgacaagtggatcctaccatttctattgaaatgcaagggatgtagaatagtcaaaacaaccttgaaaaaagaacaacattggaggagttaactttccaatttcaaaaactactacaaagctacaattattaagtcaatgtggtactagaatgtgaatagacatatagatcaatgaaatagaattgaaagttcaaaagtaaacctttgcatttatggtcaactgatttttgacaagggtaccaagagaattcaatggaaaaagaatagtctttcacaacctggtgctagaataactggatatacacatgaaaaataatgaaatttggccccacctcacaccatacacaaaaattagcttaaatgtatcataaaagaaaacaaataatctgattaaaatgggcaaaacacttaaacatttctcaaaagaagatgtacaaatagctaacgggtttgtgaaaaatgctcaacatcactaatcattggggaaatgcatattacaatcgcagtgagatgtcaccttacacctgttagaatggctgttataaaaagagaagaatgataacaagtgttgatcaaggatatggaaaaaaggtaacacttgtatatcattggtgggaatgtatattagtacaaccattatggagaacagtatggtagctcctcaaaaaactgaaaacagaattaccataggatccagcaatcccacttccgggtatatatccaaaagaatttaaaccagtatgtcaaagagatatcttcactcctgtgtttattgcagcattagtcacaaaagccatgatatggaatcaacctaagtttccatcagtggatgaatggataaagaaaatgtggtacatatacacaatggagtattattcagccttaaataaagaatatccttttgtttatgacagcgtggatgaacctggaggacattatactaaatgaaataagccaggcacagaaagtcaaatactgcgtgatctcacttatgtgtggaatctaaaaaagtcaaactcattgaagtagagagtagaatggtggttaccagaggctgtggatttaggggtggaaaatggggagatgttgatcaaaaggggttaaaaactttagtcaggaggaataagtttttgagactttatgacacaacctggtgaccatagttaataatattatattgtatatttcaaaattgctaaaataacagattttaaatgttcttgctataaaatatgataaatatatgcagtgatagatacgttaaattgctcgatataatcattccacagtgtatacatatatcagaacatacatgtaccccataaatgtatataattatttgtcaaagcaaaataaaattaaaaataaaatgttttaaaacttttgtaaaataaactttataataataatatatttttaatgaatcatagagctaaatatattaataagaactaaaactttaaaactcttctaagaaaatgtaggaatacaatggattatgcagtgttttcttagatatgacaccaaaagcaaaagtaaccgaaaaatacacaatttggactttaacaaaattaaaacttttgtactgcaagcaatattgtaaagaaagggaaaagacaatcctcagaatgggtaaaaatatttgtaaatcatatatttgataagatacttgtatcaagaatatataaaaactcataattcaacaacaaaaaggataaatgacttaattacaagtgaagaaacagtttgaataggcatttctccaaagtagatgtatagatctccataagcacatgaaaagatggttaacatcattgattgtttaaaaaatgcaaatgaaaaccacaaggagatagtactttttacccactaggatggctaatacaaaaaatacagacaataacaagtgttgagaagatgaagaatgcttggaattttcacattactggtggaaatgtaaaatggtgaaacaactttgaaaacagtttggaagttcctggaaatatttttttaatttttaatttttgtgggtacacagtaggtatatatatttatgggatacaggaaatattttgatataggcatacaatgtgtaacagtcacattggggtacctggcctatccctcacctcaagcaattatcttttctgttacaaacgacaatctaataataatcagttatttttaaattcacaataaattttttgactgtagtcatcctcttgtgctatcaaatactagatcttattcattctatcaaactatatttttgtattataaatttcactacccattagccatccccccctttccccctaccactacccttcccagtctcctggaaatattaaacatgaagctaccatatgacaaaaccattctactcccaggtgtatgctgaacagaaataaaaatacatatgtacacagaaaacctttatacagatgttcatagcagcattatttataatagccaaaaagtagaaccaacccaaatgtccatcagctaatgaataaattttaaaatgtcctctacatccaaaaatggaatattatttagcaataaaaagaaatgaaatactgatatgcactgtaacatgagtgaacctcaaaaatatgctaagtgatggaatccagtcacaaaagaccccaaattgtatcaatacattcatataaaacatccagtaaagactgaaggaggaggagaatagacaatagaaagggactgttaattggtatgggtttcattgggggcaaataaaatgttctcaaattagatcataataatggttgcacaaccctgaatacattaagaaccagaaaattatgcactttaagtgggagaattttatggtatgttaaaaagtatatctgcatgtcattgactacagatcttttcttattttttcaagttttatgaacacagttttagaaacatagtctccatttttctctttcatgaagctgcttgccagctatagaaatgaaaaaatagccatgtctgtggaacataactgctacctagatgggagcctccatcacacaatggatagggagctattttcttttatggtcaagataggcaggttctgtcctatagaatatattctgagatgttacctgtagttcagaaaaacagggatattgttgttctaaacatttcctcaacatttatgtggcttcctatttattaataagagaacctgttctttatgtgtcattatactagtttattctagccctggtcctggtccaggactgtctggaggtattagaattgccctactctatgtgaaataaggtcatatctgaataggtatgtcagtcagcataggctaagctacagtaataagcaacctcaaatctagaggcttaatagtctatattttactcatgttacatgttcgttgtagactgatgagagcattctacttagcttagtcactcggggaccatggctgatggtatctccatcttggtacattctttcatgatcatagaggcaaggaacatggttcttgagccttctgcctggaagtgaccagtagacaaaaccagtcacatggccattcctgagttcaatgggaatgccgatgtataatcttctggcgtgaaaaggcactggatatttgagaacaataatgcagtctaccacaatatgctcatggggtctgaaaaggagctgaaaaaacgccattttctggggttctgtcctctggcattgtttctggaatcgtttccacccatccatttctacaccctctcaactgacttttctcagatgcctggggtagctgggtgatttgttaattacagtattgcttaagccttttaataaagtcagcaaattaaagagagagcccagataaagagaatgctttcaaaaatgtcataatgaaattaaggtaacgaagcacttggagacctctcctcccttctttttgtatgaaacttattccaaagcagctggaagagaaatggggcctgaaagtaaagaggggaaaaatatattgtatgccattagtttaattataaaaattcattacatgaagccatgtaagacagaaaataatggaactctaatgggttggccgataacacatttactagtctgctctcagcttgtagtcattgttgaaaggacagaaaagtaacgacgttggtatgtagtcttcaaagctattgtaaagattaatcattttcagtaagccggaaaatgagggccattttcttaaatagtatgccctgtatagagtgttaccttctgaaacagagttgtttggtaatgtcagaggtttaatagatgagtcttgaagttaatggtgagaggctttacttttgaaatggctttcttacagctattttaacatttctattataaatccataaagaggttttataggtcgttttaattcacacaaggagggaagaaattgtgcttctcttttcccaataaggatttatagaacattaattcattcttgggaccaaattgtttagtgattttcaaaaataaactatgtatttttctgctgtctttttttcagaaatgccttactttattatacataataattttccagtcatgctataatcatcaagattgttttatattcttcaaagctcagttaaaataaacccagtccttttccttaaatttctttatatggatgcataacttctttaactgaattgaaatgaaacctgaattgagagtccagaaacctgcatttttatgatgactctttcactgactagctatgtcaccttgaacaagtcacttaacctttcagagcatttatattctcatgtggacaattatggaattgctcaaaaaggaagaagatatcaaaagatgaaagtgaatatgtaggtaggggtcatatattcgagggccttgtaatccaaagagagaggttaggactttgtcttgcaggtaatagcaaaccattgaaaggttttacacagaggagaaatgaggttctatttgcattacaaaaagatcatttacgcagttgtatgtaggtggaagggtggtttgagagtggagggagggagccaataaaaaagattattttagtacctgagcaagagatgatagggacgtaaattaaggtagtgtcaatggaagtagaagatttggataaaagttaaaaaaaaaaaaaaaaaaacttatgatacaactacccagggagtatgttccctgcctcctgctccagttgaggaccaacatatcagattgatccagagacagaattttggagaacattaatatttaaaggacaggcaaaaaaaaaaaaaaaaaagcttgaacactcagagaatacagaggcgaccaaaagagtggaagccaagaaagcagagaacttcgagaagagaatagtcagcagcaccagttgctgcaaataaatcaagtaaataagaacttaaatctttccataggcattggcttttggtaactgaatcagttaactattttcacaaatgtgagtggcatatagcaataagcccatattgcctttcatgaattttcagcttgggtggggtggcacttcttcatgttgcaggttgattggggtcgctctgctccatatgtcactcattctcctcctgagatgagtaggctagtccagagcatgtttgtcttaaggtaatggtgaagtgcaaaagggatagccacactgcataaatacatttcaagcctctgcttgtgttacttctagtaatatcccactgggattaggcaaagcaaggcgcatgaccaagctcaatgtcaagggcatgctgtctttcgtaggaagaatttcagagttacttagcaaagggcatggatacagggagaggtaaagaattggggccagtaattcaatttgccatagtgacttctgtcagaatagttttagtggaacgatgatggcagaagcctgattttcatgaattggagagtggcacgaatgtagtcaagttgagataatgagtgaatatctgccttctaaagagtgtgactgtgaaaggaaagaaaatgatagagtgcagattattgttgttgttgttgtttaaagatgagagagacactcatgtttgaagtctctagagaaggtccccgcagagaggcaagaagttggaacacacaaagagagagggagtatgtggaggaggatcccagaatagatgggtgcccagatggtgaaatcaacttccaatagcagaaaagtcgcctcttcctctgagactagagagaaggatgcaagatgtaaagtctgatatttcatgaaatgtatgtttgatatattaaatttccccctgtggaattgtaggtaggatcatttactgtgagatttctttcagttcgtgttgtcaggaattagtctgtaaaccacattcgatatttcaaacagaggaaattcaatacagaggactggctcctccataggaatgaaggagctgacaaacccaacagaggacagtgaggcaacccagagtttagcaacttcaggaaactattaccacctcaagggctggggaaccgacaagttttaccaaagcccagaaaccagaaccatcgggtgctaattcacccaatgtaaggtctgcacagcaggtaatggaattacagagggagcagccgtccagtgggaaacggagacaaaggagatactgccaagacagagagagaagggggataattatcttgtttcaccctttctcatgctcttctgtctcccactagtgtgtctcatgacttaacctagttagaagccagctagcaagaaatcccaggaaattctgacctcctatgggagttagtacatctcaatactgagtggagtaggaaatgggtagagaatggatctaagagcaaacgacctcttggtggttagctaacagagttaaatttttccatgaatcccttggttcatgaatgtaaatacaggatccaaggaaaaataacaaatccaacatgtagaactttttgttcataagcatattaggatcctgttttacaattttccgagcaattgcttgattttgacacttcaggacaagccggaggcatggtcagagcaagtaaccccatcctagtttacagatgacaaaactgggacttacaaggttaatgacttccttaagatcaaactgcagaacaatggacaagcaaaacttcctgggaagatgtcctttcgttactctgcactgcctttcttgaagttcctttgagacacagtcattaaaaatttaagtaatagttcacccggaacaaacatttattttacttgtaggtgaatatcacaaaacacattttaaaaggaaatttaaccaatattcaaccttaaaattttaatgatagagctatgcacttgcttttatcttccaagttaaagggagaattttagagttgcagcatttctagacaatgtccataaaacagcgagctacttgctttgcattcagaaggggctcacactgtggggaatatagtttgactcattaaaattagtagtagatgtgctagcagtagtaatgatgatgatgatgctgatgctgatgatgattaatatttatttaatccttcgggcacgccaggcacctttgtaaatgttctccctgaattctctaagttaacccacctaatcatatttccacataaatactgttaatattcccatttagcaaaggaggaaactgaggcacagaaaagataattaactctcccatttgccactaagcgatcacgccaggattcaaacccagcaggctcattgtattgctcaggcttttagctactctttctcttcctcctctcttttctaccatgtagggtcaatatcactaaaataagttcttacacataaaagaaatgagagaagacaaacaattaaagtagaaaaaaatactcaaaattcttgaaattaattcaggttgtctcatagtccacaatcactttttctacctaagatactgtgaatatatatcaagcacatagtgcagtagcagcataatgggtttgaatgtgaaacatttctttcctggttggggaaacaatcttttggggatttagcattttatattcttcatagaaaacacacacacatacacacacacacacatacacacacacacatatacaaaggcaatctttttttataagctagtgctcacagtattttaaatttcttcacacaccatgatcaccacacaagcaattccctgtggtgtacaccattgtcaatggaattcagaaagagaaaagggtgtgtgtgaagtctgttgtatttttgaatttacactccttctgaggtctggagttatcccagtagtaaatttcacagcagtaggcaaagctggtcaaggtcatggttcctagtgtgaatgacacttgggtaaaacccaaggtgggcgggcagaatattaccgtaggagaaagggaaaacattctgtgtggggaatgtctttaagaagggagaaaaaaaaaaaaggctacctttgagaacctttgtgtttatataagggcctgagccccctcaatgtcagtcaaggtcagtgggagttttactttttaatcctacatcctcacaaaacctgggcagtattcagtgagggttagcactcagtcaagatttccttaggtataacagtcctaactttcgctgtgaatacaattttgcagaaaaatatatggcacgcgtatttctacctttcaagcattaaagtacatcaaaaagttctggtttgacgtcaagcctcactctttactaccttgtttagtaggaaatctgtcatttaactctagcttactatttctttcagagattttggaaaattctaggatatgttataatttataattttaggcatttttatgatctattgattatgtttttagattcattggcaccttctgcattttatgttttttaattttaacagctttattgaagtgtaattgatatacaaaaactgcataaaattatatgggctagaacatgtgcatatacccatgaaaccatccaaatggtataacctcttatatctagacttttcaaacaggaacctatgagtgatgggtggcttccaaggttatttaacttgcttgagtaaaataaatgattttaattatatatttactaaaaattttgtttttattttgtattcctgagcttttacatatatgctctgatactggtccatcataagtattttattaacaattcagtgttttataaaaggaattcatttgaaaaaaaggtaaccaagttattggtctcagttttgtggatgttcatgctattaattagcaatttaatagatgagagataataagctcttcttttaaaatgcaaatagcaccctctggatactaagggccaattacatgttctttcgtatcttggaatacatttcttttatcactttaggtttggcttaagtgaggaggagaaagaaagaagtggtaattttgtaccctaggatatttctagaaaaggcaagcctttggcagaagttccctcagaagggctttcaaatagtgcgaggatctgaaaagtggagaatagaaactgtaatgcttgataaaaggagtatggaagaaaaggcaggcattccacgcggataaatgttaattgttttgtaatagcagcaactatgctctgtgcctttagacactgtcctctgctttcatagcaaaagtcagtgatattggcattagcttcttgataatagtttggtaatctgggtctatttgctatatgcagtaaatactattacttggtttgattctaggatgttttagttaactgagaaattacattatatatagattgtatatgttcaataggagttcaccaaacacgctgaaattatgctaagaacactgtttgatttttattctgtaaatatcatactaacgcaaaagaacaaatattaaaacaaaaatgatttttctcctcagaagcattattttcaatttcttccatttcgtgttcagctcatgattatgtattcttagagataaacacagtgtagttaaaaattgtgttctgttttttacacaagaaaattgtgctctttttacagtgattactgtgcacatttgctacatattggaccattggaatgatgtattatgttcttttaatgtccctgcattaaacatcgacattgtttctctttttttttttttttttttttttttttttccgagatggagtctcactctgtcgcccaggctggagtgcagtggcgtgatcttggctcactgcaacttccatctcctgggttcaagcaattctctgcctcagcctcccgagtagctgggattacaggagcctaccagcacacccggctaatttttatatttttagtagagacggtgtttcaccatcttggccagactggtcttgaactcctgacctcgtgatccacccgccttggcctccctaagtgctgggattacaggcatgagccaccgcacccggcctgtttctcatttttttactgctttggttaatgaagattttaagtcatatagtatattgatcttcttttgaagattttatcaggataaagtaccaaaagtgagattattgagtcaatgggaataagcatttgtatgtcacttggtatctattgccaaattgtcctaatagataacggtccccagcagtaatacgtgaatgtgctagttttactggtcttttcagctttggattttattttttgttaatttaattggtgtccaattgtaccttttcaatttaatactctattttttattacttgaaagttaacttttttctttttaaataaaatcatcccactctttctcttgtttgaactacctgttcctattcctgtgtccatttatcaatgacttaacccatcctattgaatttgatataactatcttaacaattagtattatcttaatgcttagaagcctcctctctgcacttgcagaaatgtttaatagaaatttcaggttgatatgcttcgagataaaacctaccattaattgacttctttctttgaaatatgtttcaagtgatgagatagcaagtttgaaaacactgaattgccaaagacaaacaacgaagaaaatgtaggtgatttggtttagtaagattcttatattttgactttttttctaattttaaagtaaggtattctaaaagtattttgatccttcaaaaaattcgtgactagaataacagtactattcttttgttgttcaatattttctgtatgcaggtttagttgaacgccagtagatggcactaattacataaacaattcaacaagttaatgaagagggaaagaaatgtatgaggtttttttcgttcaaatgttgttatatgtcacatattcaacaattatatatgagcttatttttgtagtttttttctcttgtgataaaaacaattaagcccactttattgccaattaattgctactaagttgaaatacttgatactggttattgctcaagatgctgcatttgaaaagtttgtcctgaaaggtgggttaccttatactgtcatgattgactaaatcatatggtaggttaaaagcaatctaatatatgtattctgacctgaggattcagaagctgtttacgaagtattttaagacactccaactagagatttcataaaaaaaactgacattcattctctttctcataaaaatctatagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaaggtatgaattacattatttctaaaactactgttggctgtaataatggggtggtgaaactggatggaccatgaggatttgtttttccaatccagctaaactggagcttgggagggttcaagacgataaataccaactaaactcacggacttggctcagacttctattttaaaaacgaggaacataagatctcatttgcccgctgtcacaaaagtagtgacataaccaagagattaaacaaaaagcaaaatactgatttatagctagaagagccatttatcagtctactttgataactctatccaaaggaatatctttctatctcatcatggcgcacactgccttacctgttatctgataaataagtcactttgggattcatgatagagttatagctgtacatggtctcatcctagtatctcactccacacacccaatgggaaaatttgtggagggcaatatgactcgtcacttcatttcccattatatatgaatggaaattaacagcgcttatagacagtatctcctcaaactaagccttgtatccttattatacctctcttgatctctagtgcttttttcactagcatttattccaatcataaataaaaatataaattatgtaactaattgttaaatatttgtcctttaaattaatctaaatgccatgagggcagagattttgtctttctcatttgatacatccccaggtcctgaaccacgtgatataatagggagctagtaaatgttttttgaatgatgactccctttgcagaatgtacaattaccttgtgcaagctgaaaaaatagcacctgtacaatatgaggaagaccacggtgaaaaataattgagttccaaaatatgacatcaattactgaaaaaataagctcggtgatttttaacaagaagtaaaagtcaccactggggccaaaacagattttgaactaagagtaggaagtcttaggagaaatgagataatgatatatggaaattaagcggccaactaaattttgaaactgagctagacattagagagtaaaaactcctgtgaagctgaatttaagctggtcaccctggggaatagagcaactctaatcctgaattccagacagtaggtgtatagatggaaaagaccatggaaaagaagattcaacctaaagttgggaagttttaattggagccctatgaaaaagaccctggtggagaaagggcaaacttgaatatggagctgatatttggaaaaattctcatagtaactactttttctcaatggcaaggcttggactttcttctcaaaatacagatcttatatgtgttcaattaaacagggacagattaggttcaggaagaattattcacatggaatcaattggtatcagagagtcaaccattagatcttagtgggaaatatctgcttctcaaagagaagtcttttggggaaagcaaattaaagtcagagattaatttgatgagtttaggtaatataaactaaggggccaagaaaaaagcttgctcatggtatgaaactagagcttgaggacactgatctagtctatctatactactctttctgacagacccctctcttcattctcatgctccttgatggcccaagccactctctcagttttttaaaaaattgttttatcaaggtctctggattcttcatgggaatgacttccagtttatattttttggcttggttccaaaaagctatcagctaaggaatgcatatacttacttcccctatgggtaaagtaaatgagaattttagaagccaactcacatttttagcctgtacagaatctgcaattcaccaagctacttctgactcatgtctataaagttcttccctgttcttttctcacttcacatgtactctttgcaagaattcatccacttgtgtagtttcagtctgttgatgactacccatctataattccagctgagaatgatcttttgagttttagacatgtagatcctgctgctttctttcgatgttaatgtcccacaggaacttcacattgaagaggtccaaagctaaactcatctttgccttcttccaatctctttctccaaatgcaacctacttctgttgtccttgtcttagtccttttcgtgcttccgtaacaaaataccacagactgggtaatttataatgaacagggatttgttggctcatagttctggaggctgcgaagtccaagatcaaggggctggaatctggtaagggccttcttgttgtgtcatgattccatgatggaaggtggaagaccaaaagagagaaaaaatggggccaaacttgtccttatatgaaactcactcccacaataatgatgctaatccgttcatgaaggcagagccttcatgtcctaatcacctcttcaaggtcacatttactactgttgcaatggcaattaaattttaccataagtttgggaagggaaaaacattaaaccatagcattctgcccccttttccccaaaattcttgttcttctcaaagacaaaatacattcatttcatccccaaagccccaaaaatcttatttcagcataaactcaaaagtgcaatctaatataaattagatatgggtgagactcaaggcacaattcatcgtgaggcaaattcccttccatctctgagcctgcaaaatcgaatcaagttcatcccctcaccccctacccttcccagcatcaggtaaccaccaatcacagaaagttttactgatagtcctgctctagatcatctttgtctatgttcactttagctatttatcctagtgttccattattggaatactaagcatgtgggaattatttatattctactgttcaaggtcctcaccaaggtctgattgcaaaaattcaaaaaattgcaaccttaggcataaatgggttaagcagtttagggtacatttataataattatttactgtgctacttcaaaaatcttattgcctctatttataaataaaaagtgttgtctctacacagtggcttgttgtaatgcatttacttgtttctgcctgattttttctatttatacattttcttttttatttttatttttattttttcacttttaagttcaggggtacatgtgcaggtttgttacataggtaaacttgtgtcatgggggtctgttgtacagattatttcatcacctaggtattaatcctggtacccgttagttgactttcctgatcctctcgctcctcccaccctccacactctaatagtccctagcatgtgttgttcccctctacgtgtccatgtgttctcatcatttagctcccacttataaatgagaacatggggtatttggttttttgttcctgtattagtttgataaggacaatggcctccagatccatctatgtccctgcaaaggacatgatctcattctttttttatggctacgtagtattccatggtatttgtgttggtctcaaaaactacaactatgacaggatggcattttcacttttgttgttatattaaactcatcttaaaaaggaaagattaataatgtcaatatttgggttatggagaaaaagtatctcatatctttgaaaaagttctgtaactatagctttttaggtaggagggattctgtggaaagttttctgattacatcatttctcacagttcaggttagacaccattttactatgaaacactaatgcattgcctgcactgagactttcagtcacatggagaaacctaggcaaaatttttgtacacttggaagaatatttaaattagtaataaaatctttagttttaaactgttgaatgttaaataagatataaaatgtacttgaaagaaatttgctttgatatcagacactgccatgttgcagtttcaagacataataaaaaagtaaactaatgtttatattttgctgtttaagtttattaatacatcagatgagtcttcaaattctacagtggcttttgatatgatcatttttacttgccattttatatagaataaatataaataggcatttatgcttaaaaggaactaatctatctatggaaaaaagagaaggctgcttctcaactaaattgtacagtttagaaacccagatctgaacatagattattgttgtgacctatgtaggaaaatatgttgttttccttatcgtagtccttacagagtccatgataacatataaagccagaaatgtgagcctctgcaagttcatttctttgtcttcaatctctgtgaatagatatgagtttgtgaataagataatattagatgtgatattacaaattattgtgagaagcctctaaggattagatttcaaggactgccatctggctgatgactttatgatgacactgtcatgagatttcatttccttatttctgttccaggatcactctttaaacaagaaataagcattaactctgaattgtctgcttgtagctgtatgagggcttccacaactgccaactagccaggtacaaactcatcaagcagaggagatggtccttgcatcagagggttaaacatgcctagaagttccttagctaagctcccagatactaaaaaatccctctaggttctaagaaagattcagcatgtacatgtgtgtacatgtatgtgtgtacatatatacatatacgtgtatatgcatatgcatgcatatacatacaaacacattttcttccataacatctcagtattctctgttctttataatactgttttgtattttaatgatcaaaattaatagttgatcatctgaaaacattttgacctgttttctccgtctttgacaaccttgaaggcacttgtaagtcactctttgcttctctattcctaggtcctttctcatcttcattgcaacaagaaaagagaaaacaattgagccctattttgtgtgtagcaaggagctactctagttaaacactagatctcttttacattctccaacatgttgttttagtaattattctactttcctttttttgggatattcaatttcttctttctttttgctcctcccctttagcaggccaacatactcaagtctccctcatcctaagagaacttttttagtatatcattttttttctatccagctgtacttgcttctgcttactatatcatttttaagcagtagttggcattactgtttcctgttctttagctactagttgtactttgacccactccagtctcacttccccagcaccaccactttatgaaaacaaggacttactaagatcatcagtgactttgtaatagctaattagtgtattttaattcgtccatcttcttgactatattttaacattgatcctgttggtcaactctgctaatcaaaactttatcctccttggttcccagaacaatattatcttgaatatctcatttctctaatcatataataattgtgaggtgcttggcacaatgcctagtgcgtagtaagaactcagtaaaatatcatctgccatcgacaccataaaaattaatttacttactcaacaaatacttttgtatgaagtttgtgctaggtaggcccagtaattggtacttggtatagagcaatgaaaagccctaccctcataaagcttatattcttggaagcagaagttggaagacagacattgacaaataaaaattaaatacatgatgtgtcagatggtcatacacacagtgtggaagaacaaagaggaaaacaagtggagagagagagggaggtggaagaggagtgctgccatgaaaatgtggtaatcaaaaaaggtcttactgaaaaggtggcatttaagcaaattctaaaagacctgaggatgtgggccatatgtataattgggggggaaaaagtagtccaggagagtcctaataagttaaaatgccccaaagcaggaatattcttggcatgttgaaggaaccttaaaagggagatcagttaggcagaaaaggatcaagcgagcaggaaggtagttgacaataaatttagaggggtaactggcatctgattatattggccttttaggcctgtggactttagcttttaatctgaatgagatgggagttattggagggttttgaatggaggagtgacatgttttgtcttatctggctcctctgttacaatagactaaacagaagtagtgagaccattaggaaactgttgtcataattcagtcaagagatgactgtggctgggatcagaatgggagaggtgaatgtggtgaggagtggttggattctactatattttgggtacagagcacaacagattttataatggaataaatttaggtgtgagagaaagagtcaagaagactcaagaatttttagcctgagcaacggaaagatggggtcatcatttactgagatggggaaggctccaggagtaacatattttgggaggaagatgtggatatgttacatttgaaatgcctattatacatctaggagatgtgtggagtagatagctggatatatgaatcttaagttatggggagtagctcaagatacaaagttgggagttgtaacaatgatcagtgcaagttctctgtcttcaatgcaattttaaatgttgatgttccattcttaattgtctctcttctttctctctgcacattttgagtagctttgtctgttggcttcagttaacattaagactcctcagtgtcaacttccatcttacactcttctcctgatctccagaactgtactttctgccacctaacctacattaccacctggatatgctacaggctgcaaaatgtgtcaagtagaatgcattatcttgcccctaaaagaaagttaaattttctgtgttttcagtgtagtgtaattgtctaacttaattgtctctaaaactggaaacctaagaattaccttctacctttctcttgatctctctttcccaatctactgacacatgtattaaactggcttccaaattctgtgaattctacttcaaaaattgctctagaaacaattccctctctttatccctattgtcacctcatcctaaagcctcttcatcctttgtagatttctgggagattgtaaccaacttttctctattctgccagttatcaagtctttacgctcatttgacattcacaacagccttggatctgtcttccttgaaatgaatcttcttgcttccctttgattccagtgctttttttttaccctcctgagacttgatgcatgatatttacatgtatgacatgtttccaaaagcattctcaaatttttctgaaagtaaaaacaaatgaaaaagtaaaacattttcctgggaagaaaagcaaatagtgttatacatttttgcttgttcatttgtttgtttatttaggagagggacaagcattagaacttcataagagtcttatatgctgtatctacaaataccgtcccttggcaatataattttagagttccttttctggaactacttaaggactgttttatgatcctcagcagactgttatattattttatagccataccttttatttgctgagtaattgtactcaataattgtttgtaattgaatgaaacaattcatcagatgttgggcactgaatggctttggattatttccaaaaatttaaaggataaagatttgctgccttcaaagctatgtacaaaaatatgatagaatgctagcgggatatttgtttaaaatacaacctttattacattggggcctgctcataatatatatgtggcacattttatttaaaatattaaagttcctggtgggacatgtccccataatcccagcactttgggaggccgaggtgggggtgggaggatcactagaggccaagagtttgagaccagcctgggcaacatagtgagataccatttctacaaaacataaaaaaaaaaaaaaaaaagccaagtttgtagtcccagctacttgggaagctgaggcaagaggatttcttgaacctaggagttcagttcaaggctgcagtgagctatgatcatgccagtgtactccagcctgggtgacgtagtgagactccatctcttaaaattaaattaaatttaaagctacaaatgaccccaaagccaccagttcaaccctctcaattttgaataccctattttaaattcctcttatgcgaaatgtaccttgtagtccattttaaggactgagaggatttggtatgttaaaaaattcaatccattatcaactcctttaggtacacttagcagtatgaaaatgtgtctttcggctcttcaggagagagtcatatgtatagttacaagacaatcccatttttatattgctgagacccaaatcttcccaactgattatgaagcataagaactcttcggaggtttaagtgagctgagattgtgccactgcactacagcctgggcgacagagcaagactttgtctcaaaaaaaaaaaaaaattctctgcattctacagtagggtaatataacatctatgatgtgaaatcttggggctccgggccagagagtgtcatgatccatatggatctaaaaggttcatagtggtaacagcctgcttcattttatgtcatctcctttcaagtaattagaatgtttctagcttgcagggattgcacacaaagggagacatttggaaccatgtcattggtgatttactggtgtggaaaattacctggtgatgtagccaagtagccattttcattctaacccagtcctacagtcctgaactgggctgaaccaacgcaccaaaatatatgcttagaaatgctcctatgtatcagttttcccaggaaaaacaatagtattatcgaaaacttaccattgtttcctaataaaaaattataggataccaacagactgttttttgttcataaatttaatattacagtatcaaatattaaagcaaatgggagaaagtttttcttatttggtttaattgaaccattaatgttagctacaatacccatcatgttacttttcaattatatttatattttcattttatttctatctgtatcattctcagaaagacttctttaaaacattcaataaaaatagaatttaggtagatttatttttagaaagttgagtttttttaataaatgaatataatcatcacttgacttaatttttttctgcacaattctagaaatcttatagttttgggatcctttggctttattcagtatgtaacagggatctgtttcctttctctaaatcattaattcaaatgatttcttatattaaaaatgtttggacatataggtattaatgagttttatgaaatctaatctttccaatttccccctaaaaagggatgtcatttaatcagttctaggttgtgatcaatagcagatttttttttttttttttttttttttttttttttttttttttttttttgcagctccctttcaccccgtagggaaacctgatatcatccttgactaattgcagcaaagagcctggctcaggtcctttgtcttataccgagtgtttatagattcttgagcccagcagaatctgaactcctggctactgctacctacttcccagcccaggccccaaaagccctatgtctgcagccccgtgcaccactgtgtgtttttgtggcatttctgaaacacagagctacttaacttgtttctaagcccagattgtgcctttttgattttctattttggtattttatctaccatttttctgtgtttggatgtttcttctatattttgaaataacttctttcctttagtacaagtgattcttattgtagaaactatcaaaaatttacaaataaagaatcattctcaacattcttagcaattccttctatcatatttttgcaaatatatttttgcctatttttattttacttactccctgtttattaacagttaaaagcattttcagatagttttattttttcatttaaaaaaatcttaccacatttttattaggaaggaaatggacaggtgtttatcttttcaataaaaaacatgggggaaataatttcttgaagtacatagtgacattcttccagccaatgttttatgctgtggtcattccgtctgtcatcagtattcatagaaagagatgaaaattatttaaattaactaggaaatcaattccccattcaaagcagtagttgtgtgtttcaaatatcttctaatagtcagtttcacacttagctttatcaaattcctaattatgatactcattacatcactctgtgtccagtcagtgtgtttatgccacagagcaattaaagcaaatcaggtgaaccaaattcaatcacctttgtagataataacctacgttgcttaaacttatggccgctcatacaattactgatggattgcctttttcttttatattgccagtattttaaatgtcctagtgaagttggggtagctgttgaacttcaactttatcacaacctcttttttaaaatgtgtaaacgaaaaaaccctccatgaaatgaccaaatacagttttcatgctgggacaaattagatgaataataatcataaattcataatgattatttatgattttatgtttttatagtgagatatgttttgttgaaatgtgttatataagtgatacttaagtttcctattaaaatagaaatgctaaaatggcattgttctctttagctgtgagtctagcttttgacctctgcttaaacggaactgttgttccatcccaaatctgcaactctgaggcctatgctcccttcactgctgtctaatggatacctatcaatttggaaggaggtttcaggcagctattcccggtaatctaatctcagctctgtccttttcaatattttcatcagtggcttggatgaagacatagataacattcttatcaaatcaatgccacaaagcagggagaaatagcaaatatagcagacaagagtatcaggagccaaaaagttttcaacaagttggactggtaggctgaatactgaaagatgtaatgtaaatgcaaggtgctacatgtgggttcaaaagaaacatgaaacaaaaaacccatctaacttagactgggctccctggaaatagactaagatagagagttgtgtgcataaggtttgttgaggagtgttcccatgagatacatgtgtaaggttgtaagataggcaagattgcacagacgaagaagtgcagtgaagcctgcagtgcgttgcggcctcatcagattttcaggggagttctggaaattgcatggccctttagagacacgctgaattgaagcaagggatctggacctttgaacccaatactagagagttaatggtcctgggtcaccccatgggaaagagcagactggagtaagattgttacctacagctgaaggcaatttccagggagggaggcagctgtgagctgttagtagtcaatattccaaccagctagggcatgaggtcttggcagagcaacagtgtacccaagaccgcagtgttacccaaagtatggtcctctgactggcagcattggtatcacctatgagctcactagaaatttaaatttgtaggtcctaccccatccaactaaatcagaatctctggggatgggacttggggaacttttaacaagctttcaggcctccaagttatttctatgcatattaaaatttgagaaccactgcctacaccaaccaaaaacattccaaatatggagataacatagagtttttagcaacaataatctccttctgtttcacttctctctttacacacacacacacacacacacacacacaacacacaacacacaatgtgatagaacagtgggaaaggaaagccaaaggggatcttaggccgaataaatttaagcatataacctagtcctaagaacgtatatttcagcttaatagagagaggaatattgttataaagctgtccaaagatggaacaggctgccttgtaaagttgtagaagtattcaggaacaggttggtgataccttggtggttgtatggtataacatcctgatcttcacatactcatcatctagagtgggagttttctttttccaaatggggttttggcagaactagttccactgtatcttaataagtaataactcaagaaagggttctatggatgaaaaaatgattaggtaatatcaagttaaatcaaagcgaacagacttctttcccataggagtaatcagacccttattacagtgcatgcttggtgaatcaacaaagtatgtgtatttatgaaagtatggggggaagggataatctatacagtatgcatcccttctaaaagtttgaccatgaaaacaatttctcaagaatcttatacaacactacagtatctggtccaatactatgcatagaacatgcactcagtaagtgtttgtaagatagatagcatagcatataggccaggccactgaagggaaatcatctcaccgtgagttacctgaatagtattctctagtgccattagctcaattcttcacgtaggcataagcctatacatttgccatgctaaccaagggaatttgtgttacgtgaattttgactctattcagacatttttttctatgactcctccaaggctgttattcttacctcatattctggtagaagtttaaggacttttttctgggaatattgattaattagctagctagctagagacagagagaggatagagattgattctctggcagagcctatttgaatcatattgaatctttttttttcctgagacttcccacaaggaggatggaggagaaattttttagaaatccaccgaagtaatcagggatatcttcagtaaaagaagctatacttaataaagtctctattttagcagatggcaatcaacaatagaggcaatagacaatagagtctattaaaattgctgggatctgctaataacgtttttcttttccctgaaacaaatgccattaaccctccttgacactctgtcttcatcaacattctaatagaatggaagtaactcataattttgaggatttttttcccacacaaaacctataaaccacaccacgctagtgattacttttagcctagttgctaggttgctgctggtaacagtaaaacttatcctgacaggtaggcaattccagaagcccagccaagcacttggtgtgtgtgagtaaacccccatacacttctcatgtagagtaaccctggccaacccataactcttagcaactattcctggtggacggacctggtctactctaagaagaggccaaggttctttaatagtgcagttgcaagaaccagaattgaaagtcaaagttctagcaagattttgcagactccttggcaaaccagtggcttgggactcattcttgacttcaagcccttaattgataatggtaggacagcttgcttgcgctgggttctgctccctgggatatgcactgtttgccaaatgagtagcaggtggacagacatctttacaatttgctgtcccatattctaaatgaacgtgacattctataggtctgagttaacctatgaagtcaccaatttcaatatcaaaatatttatgacagagaaaaggatactgaggcacagagagtctgtgactttcctaagctcaaaacaccagtttgtgttaattctgacacagaaattcttgtatttgctatcagtctcctttttctgtgtgtgtgtgtgtttttacattgcagcatcacctatatgatgttaggttctgtaactttttgagaattttctcacatacagtgatgtgttactttttgatatttcaaatagttctagtaagtcttttctacttttattagcgtattaacatactggctctaagagggcatctcaccacatctttgccattcttcctggaaaggcaagtttctctccatcttcttttttgtattccaaagttttgccaaagtttgcttttgaaaatgggttacctggcagagctttattattctaactttgaaagtacaagtcagaatcagacagtggcagttatatatgcactactgtgattactatataatgaaagtatctatggtgaaaatactgatactgacatatatttgccattttctaattaagtgcttcagtaaaaattaagcactcactctttgccagatactgcaatagatattgagcacattgaacaaaattctccatatacatatatatgagtccacattctatgaaagtataatgtttttctgagaaaaggcataatattctattaatatcagcttttgcttcttccaccatatattgaaagaattctgaatactgttataatttaatgggagaatctagagaattctgtatttgctttcactgcattgatgaactaagatttttaaaaaatgtattcttcatagaactacttttccatatttacctaatattattcttatatcatttgagcacatatttcactaacaaaacaaatgtgcaatgttattagttctaacatcaaaattacactgatactttaatttttatcctattatttttcatgcagattaaaataattatagctacatcacatgttgcaagttttaagagctactttaaaaatatatgcttcaggaaagacatgattagatggggaaatggatgatgttcatattttcaaatgaaaagttttaaaaaagtgcctatcacaaacactaaatttttacataaattatcaactactaatatatctacaagaaataccatttttccctacaaaaactcttaacaataattgttaaacttagtcctggaacctgctaatataatcggacaaatgttgtcaataagaaggtgaaaaagaaagcatatatagtttatcaaactataaaatatagtttatcaaaaccaatttttcctattgacatttattcaggaaggaaaatggatgagtgaaatgaacaatggtctctaagagaggtgggagatagcaataaattcagaccacgtttcctgtcattacagcagggaagtaaaagagctacagtcaactctcgaaagtacttgggggaactaatgattccctgtagacctgtgatgtttttgaaatttaattcaacaatttgatatacaccgcaaagcgaacagatagtcagatcaaaatcggaagaacgattgtctgaatggcatccatttttcctagatgtgctgtcccatcctgtgtcaattaaactttcaggtgatcttcaaacatatttccaagtaaaaggtattgcagttatcctataaactggcctcttccccagcactgcttttgctgtggtcaactttatttctttgggctcacaaaactgatagagcaaaataaggaaaacggaacattggattaaaataaattaattcccattctgtgactcactaaaaaaaaaatgataactatgcttctgtgagcattaataaggaaatgaataaggaaatgaccaaattgttcagtggacaacttgtatgggatttttaagtattgtgtcatcatcaatgttgtcaattagcatatactttgaaatcaactaaagcaaatcagttgactaatcattaagggtctttttaaatgacaacatctaaacagcaaatgttttattttggaaaatcatgacagcacaagaatgagccagatgttttacaacatgatatccataatttaaagtatgtagtagtcactcaaaggatttctatttcagtttccttatgatttggctaagctagaatttggaaaaacactttaaggtaatgtgagaaacagcaaaattcaacatgtggattttttcactaaagcttatttctgattattttttacaaactttactaggtatatgttaacttcatgacacttatagcagtggaccgtagttttaataaaatgtgaatgtatactcttttctcaataatattaaagaatgttgactttcgtgaggatatttttatttttctcaacattaagaactgtcaaagatttaattctacaacagaagacgtgaattttgttttctaaaggagaacagaatctatagaagaagtgttgctcatagtactcagattgttgaccaatcttaaaggagaaaccgtcaattaatttaccgagaagtaataacattatctttttcttcaattatgcacatccacaaagatttggggcaaaatccacttaaatgatattatacataatagatgagtattcatatgttgtaagagtcctggcttctttcctgcaaaatgattaaaacttggatcagaaaccaattaaaaatccattctaattcccaaatgtatgtaactgtactataagaaaaataaatatttcttcttgagggatatccattagttaaggatattcataacatggtgtcttgtaggaaatgttaatctttgggtgaatagggatgtttgggaataacaagactcaaagagatgttgcacttactcacttttctctgagttgttatttctgtcatttccccagtgcgcctgtcctcaactttgcctctctccttattcctttttttttttttttttttttgagacggagtctcgctctcttgcccaggctgtagtgcagtggtgcgatcttggctcactgcaacctctccctcctgggttcaagcaattctctgtctcagcctcccgagtggctgggattacaggcacccaccaccacgccctgctaattttttttgtatttttagtagagacagggtttcaccatcttggccaggctggtcttgaactcctgacctcgtgatccacccaccttggcctcccaaagtgctgggattacaggcgtgagccaccatggccgatccctccttatttctttttatctctacctctgcctcaatggtatttctctattactgttagcatttgctttctgtgagctcttgcacactgtcagcttatatacatgttcctgttcacatgttttcctgtccccagtggttacaacatgtcttctatctcagcccactctagaattgtcttacttttccaggtctcctgctcctcagtatttttcccacttttctagattcatgttttcccatctgcatatttctcttccatgtctgcactgtcatccgcttagaagacagcgcataaggacactgttatctgagcaaatcttcagcacagccaccatgaagcatggttaccttgtcactttccatttttcccatagtgtgtgcaaactgccctgatctgcatagaaaggtatcataattgaggaaacaaaatgcacaaaaatgtccttggttattccacccctcagaaatataggagagaagtaatttacagaattacacagaataacgctatgtcacatggacatggagttatcgggttagcatataattggaaaatatttcctaggaccttgacatttactcactttttgttttcaaattacatgtccctatctattagttgcaaattattttaatgcaccgtttaccaaagaaaggctgtttcttctgaaagctttcatttgacaagtaacttgtaaaaatattcacattgtgtatctgttttccccttctagtccaaactctagttatcttaaactttgcgcagttataaaaaatcataacaaaaaaagcttcctcgttgtcattcttgtcaaaacaggtttaccagacttaggtaaacttaaaatagttagtgtaaaagttaaaaagctgatttgctccttccagcgtgtttgttgcctttttgccacagcaaaattgtaaatgtaaacgtattccctaggagatgagctgggctgcaattttcagctaattgggagaagcagccctgagttgagcactgtcaggctgatttgagtcttaagatatgatgatgattattgtgtcaaatgtaatcaagaacgtgggctctgaactgactcaagggctggctgtttttaattcaggttcgtatatgaagtagacctccggttcaccgatagtcacagctggttgtagaagagagcaatttttaaaatgctatttcattctctatggagctctagggatcagagattggatgcacagggaggggacacatcctcattctctcctgaaaaattctattaattttcagtataataaactttctcttgagattccccagtggctctgtatcggtggttttcaaacttctcagacccaatgccacccctcttttcttttttaaataacaaatactttgtaataccttctttacgattataagccaaaatatgtagacaacataccctacttatacaggcaatagtttaaatgatgccgtaactctattttaaagagaaataagagtcatttataataaaataatatgtgttgtagtatgcagttattcaggcaggatcacactggaacacaagtgaagtttttagatcacgagactatcaatgcagtataaacaaatgcagaatgacaccattgtgttgtatggagactcaaataccatgaggggcattggtcatccatagcgtaattttccaaaatgctgaacaactcttggcaaaattcctaacaccatgaaataaattttttcttggatcgttatggcagttagttgcatggctgaaaaattcaatgtcttaaaatcatgaggaaaatatcttatgtttacgtgtaaaattgagttacgttccaggtttaggtgtttataaacagggtttccacatacatgcatgtccagtgggatattccaaagtgctgtcagacttgggagagttctttgttgtataagaagtctaccatcttcattccctctccacagaatgctattatagtaacactcttcaatcactgtgatagtcaaatgtcctccctcaatttctaggatgcctcttttttttgtggtctgtataatttggttaaatatctttccagacaaatactgatttgtgaattaatgaaatagcagtattttcggagcacctaacctatttctgagtgatacagttgccatttttacaagactaaatgaaattaccatttcagacctgccagattgtctagcccagtcttttacaattctgtgattatcactgcaattataatctattttcaccacttgaatggcatgatctctataaaagggtggtgataacactcatctattctccttcccctcacatagctatatcaatcgccccctaaccagttgttgataaatgcagttgaattttatgtaaaaattataagagatattattgtagctgtccaagacatttaaaatgctaaatgcaacttacgtggaggctataagagaaatatgaacccatttattgaagagattagctaatttagtaaaacaacacagatatacctgcatacagggataaatccctattgtctaaattattgagataaaataatgttttacaatgaaaaacttttagacaagtaggtaagtaaaatgcagcagtctatttgcatttcatctgggcatttgacaaagtctttcgttatactcttgtgaataagttggagaaatactggctagatgcaagataaattggatggcttagaagccacttcatgattttacgcaaaggatgtcgattaatagaccagtgtcaggtggtgatggaagatctctggtgctatgtcacaagcttctgttctcaaccctgacacactggatgtttttgacagaacatgagtagaactacagagaggaggcccatcaaacttatgggtgataaaaagcagggagggcaggagtattttgggtgacagaagccaaatgggtgtctggacaggatgcgttttaaggcacttttggtacttgatgtctgaagaccaggatcaaacttataggcaatctgaacatttgccaaaataacaggttaattttgacagaagttattatttgtatgctgtctatttctttaatacacctagaaagtattgaaataacattttttgcagacactcattttgaaaattcagaaaaaaaattgttaactttcgtggaagagtaacagaaactcagtcattgacagctaaatacaatgtgttgcccagtaaaatagtccaccccttcactttcatggctaatataaaatttgatgaaagatacaaattccaaagattgaatatctgtacatttgcaaagcaaaacacaattttgggcacagaattgctcattctcatttttaaacatcttggttataactgaacaatagttttttataacaaagataatattttcaaattattatgaggttcaactgaaataatttatgtgaaagcaatgtctaaactctaaaattctatataaatataaattattattcaataaattcacatcaagaaaattttaagttttttaagaacaagagcctatggccttgtttttagaagctgtataccttatcggtagtaggtttattgactttaattaaatttattgagtatctattaaattgccaggaactgtggtgtgaatctttgccctcaaataatttacagtaagttgtggttgatgaatggtgatgacgatgatgaatatccagactatagtaagtggtatattcataagtcagaggattcttaaaaccagatgcaccctcagattcattcctttcatgttgtacttctaattgaaaaaaataaatcctaaattatgactgttctttataaattttaattgatcttataaaaggccatcaatacatttcaaagtatctaggtcttttaaatgcaatttttcaccctggtaattaaaagtacgaaagcaagaaactttaaatctttattttgataagttttaattagctcaagctacttgtaatcccacatcttgtcttgtaaatcatatctgagccattaaaataggtttacaattagaagggcaattcttttagaatctacttaaactaagtcacttcgacaaattaattcatcgttcagttggttttattaaaatgtatttatttcactgtaaaatgtctagtaaagcaatgtatgaagtattttattttcatgttagaaattttatgtaaaagatatcccaaaatacatagacattcagatactctctgtatcattaaccaacatttactaacttatcatttagagaaggccaaaattgtatgtactataactttgtataatttcataagaattaaaatattcgattaatgcctgtaatgccttctttctaaatcaaatcctcaagcttacctcgagttcaaagttcagtatttattgtaacacatctcatagatgacggatgaagatggtaagcaaaggaataataatttcttttctcttttcacacatatatacacacataccccataatcctaattcatataataataacagaaaacaaagggcttttgagaatagtgacatattaatatccattatatttacttcacagggagactggcaagtctaccttgagaggtaatgtcttatagtacagtggactagattgtttcaagatttgtcatttattttggcaactcacccagcttccctgaaagttaagttcctcatctataaactgttcatgataattacaacctgcctcattagcctcatcaagctatttaaaatatgaaaggaggtgctatctgtggatcctgtcaaaggagcttgaaaactgcagaacattattttagtgtaaaatactataacaatacatgttgaatataaaatggctttttcttaacttttattttaagttcaggagcacgtgtgcaggtttgttatataggtaaactcatgtcatgggggtttgttgtaccgattattttgttacccaggtattaagcgtagtacacattagatatttttcttgatcctctccctcctcccaccctccccactccagtaggcttccacgtctgttgttcctctctgtgtccatgtgttctcatcatttagctcccactaataagtgagaacatgcagtatttggttttctgttcctgcattagtttgctaaggacaatggcctgcagctccatccatgatctctgaagaatctccacactggttttcacaatgactgaaataacatacactataaccaacagtttataagcaatgctttttctccagaacctgttatttttgactatttagtgatagccattctgactggtatgtgatggtatctccttgtggttttgatttgcatttctccaatgatcagtgatgttgagctttttttcatatgcttgttggtcgcatgtatgttttcttttaaaaagtgtctgttcatgtgctttgctaaaagggccctttcaaatgtgtattattaaccacaagagagtactgagtaagagactaggtaataaaagtcacaaatatttcgatatcataattcagaatttagatcagcggttatgaaattgttcgtatttccaaattccactgacaggactctactataagtttatttcatctgttgatatgtttttagccacttctttcttttaaagtgaatctgttgtgtgtttgccatttgatattagaaaactgaacctgcctgctttgctgtcttctgaatattatgtatcaacaactaacaagctacagttagttgttttgttctgtttttctctaagttattgtggatgaggatatatataactgcacagtcttatcaggtttgtaagagatgatcttaggctcatcttttaaattggtttttatactattttaaacaaatccttttaggagagaagaaaagctgcttagtctatcaacattaggaaatatatctttaaagagtttatcactgcaagtaaccaaagccaacttaaaaattcgcattatacaaatcattgagaatttatttagaacagaaatgtgtccaactataggtcaacaccaattttaagtgtgtaattatctgggaagtagtgttaactgcatttttttctaaagatcccttacagttgtataaatgcccaaaaggatattttgagtctctgtatattaaccaaaccaaatgtaattcattactcccaacattatatttcaacctctccaaatagtaccttttcgtattgtatcagcagaaaaatataaaatgcagatcttaaagagtatcaatctctttaaaaattcaagaaagaaaaaaatatgtgtgtatagagacgtgtatttcatctgctcataacactgtgtacatttctttatcaactaatttttttcagtgatttatgagttgaaatacaaatcaaatgaaacgggtaatgcaaagtaaagtagaaaacacattttctactgctgtctcctaatgcaggtcttttcaggaaagtactaatggttttagggaaagtgtataattatggttgtttccctaatgataaattcgcaaatctctattttaaaaacattcataaggttaaaaaaatgagagatgaaatgtgtctttcaaaattccttacgtgattgataatgcctatactctcttactatctaaagtctaggtgatatgtatattttttttaaaaaataaaatgtctgtatcagtgaaggaagtttacacagatagcttcaaagctgtggtttatctttggaggattaatctatttctcatgccagtgtgttgctactgcacatgttaaaaagtcatcctgtggtgtctggggtgacaaaagatgggaatgagttttctgagaactaatcagcaatactttgggaacatttaggtcatggtttccaattaactctggagagtttgagtaatttagtaccagacctcaagagagaggggatgaaaacctcgttaattcatatgttggtgaacggcaaaccagcaaatttgcattaaaaatggatttttattttaaagcaaagagcagccagatcttttctgcaatagtttgggtaggagaatatctttgtatgtatgtgttcccttatgtgtaggtatttgtatgtttcaacgaccctgcatatggcaataacagaaaattaaatttgtgctctaaaatgaagaccaggattcagtgacataatcttccttgtgcctttctttcttttagtacaatgaatatatcagagaggagtgtattccaatatctgtcttcagagttacaaaaacttcttttctagaatgcaagacttgggctatacccccagctctgccacttaacttgtatacaaccttgggaacatcattacaattctctcagaatcaatctctccagccctaaaatgaaaccagcaaaagcctgtactgtatatctaaaaggttttttatttttatgaaaattagttaggcaaacttttgttaagcatccatcactctattttgagataaagccttgctggatgatctccacctcttttgatggaaagagtaaaacatgtttaagatacatttatcacttgtttggcaaattgagatagaagtttatgaaagcagattgatatatgttacatttgagctactgggaaggactccagatggtttatagccttaattacattgtaactctagttaaatgtttacctatctgtaccctctgttaaacttgaatatgttaaataccaaagtccatgtattattggattttctgtcaccatcatcaggcacagatcctggtacacaataggtacggaatggatgcatggatgaattattgaattagatgttggtaggcatgtggaaataagaatgaggttcagaattaaagataatctgtatcgagtgtaaagccattggcagagaatgaaatatccagctgagtatacatagaaaaagaaggtaggtagaaaaatggaaaatatcttatgaagtgatgatagaataactctgaatatgtttgaaaacatataaagagttatgtggatgttagctttaaaaattatcttccatgctgtacattagatctgccattcttcatgctgtggatgaaaagcaagcatcagaagttaaattaaaatgatgtcatatattcctcgccttacagtttcataacagaggagaaaagagaaacattctctcattgccaccacccttctccagtcatatttctaggtagatgttgcccaaaaacagataaaaccacagagttggttttgctaggaatggactactaatccaggcaatgttgacagcttttgcttctcattagtgcacgttactaatagaattgctagagattaaaaggaatcctttctacaaagtgctgtatatccataggtgacaaaattctagcttcccctcacaagtacaatataaagttatgttttaaaatcaaaatgcaatttactagcaaactagtaggaactgttatggttacaggaaatttgaatttcagattaactctggttctatgagtagcggttgatatggcaagaatcattttgatcttacatccaggtgctactaaggtctctctgacctatatctcaccaaaaaaaggaacaaaataatgatcctttaatctttctcctaaaatatcataggaaatgatagtggctaaattgcaaataaactaggaaggaaagattcagagtattttatgtgattactctataacaatgccaggccatagtgaaagtgttatttagcagaagactgagttctttgaatgttcctaatttatcacattttaaaaataacctgggcaaaataacctttcatatcagattgagcctttttctaaaaatactcaatatgtttctgtaattatacctacacacttacaattccacagtataatgcaccgataaagtatttttcatccatatatctaatagtagaatggtgtgtatacaataattaagctctttaggcttaccccggaaagcaacaagtttcccttcctttttcctttttatgtattatgttggccataagaaattgatgatattcaactcaatgcagtcttagagatttattcagaaataccatggtgtgtgtgtgtggcgggagtagggttctaatgacaggtcagaacttacttatttgatttcttcattgataatcaggtcttaaaaagaaaatgggtatgctgaaaacatgccttctgtgattctttaccttcatgtgcagttgtctctggataaacactttctttggcacgtatagggttgcactaagctttatagctccaacactccgccccttcagtagattcttgcttgtaactgatgataatgcaaacctgtattatctataggtctccttaaagggcaaccaaaagttcagtagcaattcaggcacaattactgcatgtgagaatcctccatcttgttccctttggagaccacatatatttcttaggcaagtatatttttaaaatccttgttcagcatgacaattcaggaggtcaagttctcccagaaagcagattctgagaaagtgattagcatgaaggaattttattggagagtgctctcaggattaacacctgtgagcggaggaaaggaaagggagcaggattgggcagaaggagaagctgggctaccatacagtcacaactacaacacaatcaaccctccgcctctccttcctagccttccccaggaggatctctgaagtctgaaggtagaatagcccttcagaattgtcctgagttgcagcaagggacccaggattttataccccacaactctcccatcaaccaatacgtgcagcccgtctcggggacatagtgggtaactttgggctaggcacctctctttagctgagtccagctctcagacaggaataacagctgaggactgtcagccagtagcactaccagcagctggggtcagaagtatttcagtcctgaaaaggggtccgggcagcccagcttagcatctactatgccagtcgttctcaaatctggttcctggcaactgtgattctcaagctttagcatatattggaaggcttgttaaaacacagcttgccggattttacccacagagtctctgattcagtagagctaggctgaggcctgggaatttgcatttctaataacttctcagacgttgctggtgctgctggtccatggactatgagaacactgtttcatgctgcccttatttacatactgagaatggtacacagtgctcttatgaatagaatgaaaaccttttgaaatcacattattccttactccatcaaattctcagctatttttgtgcaccataaagctggaatagctgattataaaactttgttatgtaaaaaagtacttaaccaatacagtagattctgtttgcaaagcattattacagtttctaatatctggtcattgttacttgtaaaattcagccaaattttctccagggcctgtagtttgataacttggacaaaggaatttaaaaaaaaatctaattcaagacctttggttttttttctgaacatatcttttttttctttatgattcttatttttacattttacttatcatataagccacttaaacccatatggttccggaaaatttaaaactatatgatacatttagagcatgttgaatgcacagatatggaaattaagtattcttgactcattctagactagacctggcacaattaaaatttagggattcaacgtacacacacatagattccgagagaaatgttgaagccgtaaaacccccacacaagcaggaaacaacagtcttacctattattcaagaggcacgtaaaggagctcatttgaggagattttctgctgttattgccatcgaatttttaacgtattttccaaattagaaaatattcagcctgatgttgtcaatatttcagaccacaagggtatcatttaggaaaatggtttcttactgtcctgaaagagttactgttcttccctaagggcctaatttacaaagcagcaaacttgctggtaggatttggctgaaaatcacattgtctcggtagaactctttcatctgatttatgtgcattgcattttgcaaataactcttggaaagttatttactagttactttctctggaagcagagggtaagcggcatttctagtttaaggatagaggagctaagatgcatcaagcgcagctcatcatgaagctgatgctgataaaatgcacaatattacattctctaagtttcactctgccatgggagaatttcatatttttaaattttgtttgaaattggactacattagaaaatatgtcaaatgtctaaccctgcatttatattctggaatgtgacagcttatttctgttccaaattttgcactggagatggagtaagtcttaatgcaaactgcatgaaactgccacttttataggtcacacccagtcaattgtcagcagttacacatggttcaaactgtaaggtgtatgcccaattgtagcattgagattcgtggagttgttgcagtggttctgaatttttcaagcatgatacataaaaagataaatgactcttttgatatttctccttgcattgatagtttgcctgaaaactagataagcagggagccggcagtccacgttagcccttgaactacatgaggtttaatttatttgcccaaccagaaccctacactacctttcagctgtgcagtattaaagtttatttaggagttgataaatagcttagtgcaatgcttccttttttccagtagctacatcctcataaacctattctaccctccaccagttaatgcagacagaagatttttatccagtatgagcactgaaactccactgtggaagactgtgtgctcagcaaaaacctcacccatgatgaataaacagctcttccgggggctttgctgccgctggctcggcaggagttgtttattgcctggtttgcacatcccatgataaagttgctgctgaaataaattgcagttttgcataattattgacaatcacatcttaacaagcaatgtgtatcatattcaagtgttcaattttttaaaatccatttttagcttatgtttaatcccagaaagtgtttgtgtagtaatagaaggcaaataagacatttaaatagagtactaatttcctcattgcagacaaagtttacctgaatctttttccataggactgttactgcctaaggcaattttcctttctaagctattattatatagatatttgctgagggcatatgtgtgtgtatccacaatacatgcattttatatatatatatatatatatatatatgatcaaaaatatgaatacatttttagagtttttgtcatgaaagagtttgtttcatctttttaaaatattacaggaatggggaaatgggatatgggtagaaggaactaatgtttttgagtaactgtaatgtataactgtataacgtggggcactcaacttcacaggaattttttattttaattctcatcacagcaatagatattgcagatgagaaactgagaatcagagagggaacttgccatatcacgtaagtggtaaagaacactgggaattgaactcagatctgcctagtttttaaaactctactctttttcattacacataacatttttattttggaaaatgttctcagttgtatgatcaagtagttaaatatgaaactaacacaataattataactgatgtcatgcaaaatgatagtttgcacaaaatgatagtttctatgaaatgttatttctttacttgttaagtctttcttcctttgccctccaatccccttctttttgtcttttcctctagtcttttccttttgattctaggtttgtattttcttgacttttctccttgcatatcaaatccttgttttctgcctcagagcagcatcaaagacaagcatggtacagggattttagggttttaactataaaggtttgtctcaaatttggcagtatattaaaaataagctttcaaaattgaccaacaaaaactacaaaattgaaaaaaaggtactttgaactttcacatgttcaaatatatgtatatatatttcacatatatatatgaaacctcctctgtggagaggggtttatagaaatctgtaattgtcattcttgcatgccttcccccatacaaacgcctttaagttaaataaaaatgaaagtaaatagactgcacaatattatagttgttgcttaaaggaagagctgtagcaacaactcaccccattgttggtatattacaatttagttcctccatctttctctttttatggagttcactaggtgcaccattctgatatttaataattgcatctgaacatttggtcctttgcagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagtaagtcaggcatttccgctttagcactcttgtggatccaattgaacaattctcagcatttgtacttgtaactgacaagccagggacaaaacaaaatagttgcttttatacagcctgatgtatttcggtatttggacaaggaggagagaggcagagggagaaggaaacatcatttataattccacttaacaccctcgtcttagaaaaagtacatgctctgaccaggaaaacatttgcatataaaaccagagcttcggtcaaggagaaactttgctcagagaaataacttagggattggtttattaaattttaaaagttgacatttttgagtgtttatttaatattttacagggaaagcatctgtatgaattgtctgttttatttagcgttgctaactgaatcagtttcccttcattactttcaaatatgttttgaaatgttaatctggcattttgtagctttcttcctaacatgatctgtgaaaataagaatgagatggctgaatttgtcgtagttaatgatcaaacaattttcagacaattgtttttcctagaaacaaaaattatttccataaagttccatatgcataaacagtgaaaacagaacgtggggtagttttgtttaaatgaagtcttggtgagaatcatattctgtagtacaaggaggctcttaaagtttattctcaatacctgatataattttcctgaactattatggagttttgttatgtatagttggtttttctgacttgatataataactttactagtctctcaaatacaatttggatataaatcattataataagatgattgattttttagactaactttattttttgatatttttaaactattatgaaaaactattatgaaactattatgatatttttaaactattatgaaaagtatattctagtttgaataattccagaatcaaatcataataagcagaagttcttctcctctccctcctatcgttctccttctcctgtttttcttttttgatatgatagttgatctactttgctgctctgttgcatagagtacgtaacagtggcaatgtatggctcctgaatttatcgttcttgcttcatcatcctgctttgaccccactttctcctccaaaatgcgtgttgagttagtttgatcatttggaggtaatttgtttggaacagtatcagactttatagatatctcccatggcttgtgatagaatataagggcaatgcaaatgtagagttttttgctcactcttcgatgtatggttagacaatgtaccactgtaatatatttggcttaggctatttcataaataaaattttattataaaatattataaatgctgataaagctactccagaattttaatagatatgtgggtttcccggccagatgcggtggctcatgcctgtaaccccagcactttgggaggccgaggtgggtggatcacctgaagtcaggagttcgagaccagcctggccaacatggcgaaaccccatctctactaaaaatacaaaaattagctgggtatggtgacctgcgcctgtaatcctagctacttgggaggctgaggtgggagaatcgcttgaacccaggaggcagaggttgcagtgagccgaggtggcgccactgcactccagcctgggtgacaaagtgagacttcatctcaaaacaaataaataaataaataaaaatacatgggtttacattttacccatcagctatggtaggtaaataataagctttgattaagtctattttagtctatttttagcagattactttgaaaaataaagaataacccaatgactaaaaaattattttatgtcagggatttaataaaacatatctttaaatctagttgagggcaaaaatacgtctattttctactatacaatttgtatttatatctgctgtattatataatgaaaatttatctctatttctaatctcaagaaactgcaagcttctgaatcattaaagggaagattcaccatgtgtcctaactatatttactatggaagcatggaaaataaatattttatgtttagatttctgatctctctttcaaaagcagttggaaattatgctgagaaaatgtcttagcttatcccatgttactcaagaaaatgtatttattcgtttttgtccagtggcttaaccaaaccacagtttatttgttgctcacataaagtccagtgtcgatcaggctactcttttccatctttgagctaaggcacatattacacataactttcagtgtacccgaggtagaaaaagagagagcttgggaataaggcaggggctttttactgtctcaaccccaaagtgataaactacatttattctcaaaatccagataaaactcccatagagcctctgaaaacctcaacatttgcgtcttaactataataaggttaactaagattccaaaattattttaaaacagagacagtttccctcttccctggcagctaatattgtattttctataaatccacttgcccaaggtttaaactacattttatggattgaaatgacatttatagccaactcctgatttttagttagatggttggataatgatcttttgatgaaagactcggagatgtcatggtaaaacggtgaactactgaaactattgattattgttaatggcacatttcagctgattgaattgagtcaagaaactggtgttgaagagcaacaaatggaaatgccgagcttgaaaataaataaagcagcataccttaagagattacatgcaatttcagtatttcagctaaatggaagtgtttgctttttttcctctatgaatttttattttgaacaaaaggaattttctataatatgtaggtaggagaaaagtgaaatggcatgctttttcacttcatttgaagaagctggtagcattgtattcatagattcatgctgtatagcaatcatagttctcatatattaaaaaaaaaggaaatttgaaatgcctagccaaagcaacagctctgccaacagattttgatatatctgtctaccccaaaagtagtgatgatttacttcatacaaatgctagtgaatgaagagagagggtgaaaaccttcacaaaatgtgtttttctctaagactgtcaatccgtttttctatatatggagactccagctcttgctagactacctatcactttcgtctatcagccacttcgtaagatatttattctctcagcaataatcataattcatagattctttaaacatacatgtaatataaagcatatacattctgaatggaattaacatgattaattcttctctgaaagacattagaatttcctcccgtattataaaaaggtgtaactcactttccttactaaaatcaagaactttaccgtcgtccttgtacttcaggataagggggtgtttcttataaatattgttatttctgatatgctaactggaatttttaagcaaatgtatttttatagaacgccatacaaagcctttaggggtgaaagtttcaggatttttaaattgcagatttatcctttaaataaaaaaactatattcgtaattgaatcggattatttctctatccaaaacattttctgctttgggcctaagaagagttgacaaagctgttcatggttcaaagtactaccataaaaccctgggtaactaactgaaaatggaaagactctgtctttctgaatatttcacaagagtttcacaaatattaagtggttctctaagtacccctgagagatcattgtaatattagcttgtaaagacaatgtgggggtgtgggtatgtggtgacctttatgatgttcataaaggtggtgtaattaacatatttttctcagcaagacaaactaaggagcaataaatatatgagataccttcatctgtgatctgggtcatgtctcaggccatatctttcaaatcactcccttccctaatctcgtgttttacctacgtctcctctcaatccccccattataaaaattgtcttctgatgaataaaacatttccagagagacaagtttcataaagtttgaattgtacatctgagtacacctatgaattaagatatctttgatttctaatatgttattaaaattgggtgtggtggctcacgcctgtaatcccagcactttgggaggcagaggcgggcggatcacgaggtcaagagatcgagaccatcctggccacaaggtgaaacccccgtctctactaaaaatacaaaaattagccgggtgtggtggagtacgcctgtagtcccagctactcaggaggctgaggcaggagaattgcttgaacccaggaggtggaggttgcagtgagccgagatggcgccactgcactccagcctggtgaaagagcagactctgtctcaaaaaaataaattaaaataaaataaaataaaattggagaagtttctcaccaaaattttggcgcacggattaattctgaagaaagaagaaagaatgcaatcttagtagcacaattagtaccttgaataaattggagtatcgtatttcttggactatctgagaatgcagaggcaatttaaggatccctaattctaaggagaagaaacctttagtgtattccttcctgttgctttagtttgaattgagttttatatgtattttttaatctttctattttgattgttgtctaaagagtgtgaaagtgaattttgatatttttattttgcctggcgatgaatgccttctgctctggatatttaaaaattatatacacatatatgtgtgtgtgtgtgtgtgtgtgtgtgtgtatatatatatatatatatatatatatatataaaatttttctgagaacttttattaattcagcgtatctttgctaaacacctgccatgtgtcgtggtgttaggtctggtgatacaaacatgttcagagagatgattttctttcttttttggggggtgggtaagggaaagaaggcttatacaacagaatcttatttctcacagttctggaggctgggattccaagatcagggcctggtgagggcccctcttcctggtttgcagatggcttccttctctctgtgtcctaacatagcaaagagagacagagctctgatgacacttcctcttgttataagggaactaattccatcataagggccccaagaaaggtgcttttcaaaaacagttcagtaaaagtactgggttgtataatcactttaatgagtatcaatccatatttttaagatagaaatgaatgaaattagtaaaatagaatagaaataaggagtccatcacttttaagtaagtttcaatattgttcgtaaaactttggttcggtggtttgtgtgtgtgtgtatttgtgtgtgtgtgtgtgtgtgtctgtcggtgtggaaatactggatcactttgtaacatatattcaaaagcctctgtattttaacattatttctgcctttgagaggttcacattccagaggtgaagacatacatcctaagacaaaattataatagcattatgagaattacagtagagagctggacagggtctagcaaaaacagaagactaggctaaaccttccaaagaggccaggaaactcacctagaacggtggattttaaccttgcttatgcactgggggagattttaaaaatatctctgcccacaatagataccaactgaattgagcatagcatgtcctacccatgaatctattgtccagtgagaacctctgtttagagaaagtcaccttagaagaattgttaggagttatttaggttcatggggttgaaaagagcattcgtgatagaggaaacaccatatccaaaggcttagtcagtgtggtagtgtgagaatctgaaggaacttggctggggtatggttgctacaagaaatgaaattagatcaactggggctaaattatgtggaaagacagcatgatgtagcagctagagtatggaccttgtaagcaggaagaccccttatttagcacttactagcttattgtctgacctctgagtcccaattttactcttctatacaatgagtacatcacaggattttatcaggtttaaatgataagatatatgtaaaatgcataccagagaggcagactattggactcgaagggctcagtaagtgtaagctggctctctctgccccttgccacctatttttcagactctggacttttatcactttaagtcatagcctagttctaagcaaggaaatggactaatcagacatgtttttaaaagatcattctggtagtggttaggagaatgaattggaaagatatgagacccatgcagggacaacagttaggacattatttctgtaataagccaagcaagaattgatgatcaaagtggtgaggttgaacaaacaaaacagatacgtgagctatttggagataaaatcaacactgtcatatgttttgtgggaggtggaggtgagcagaaaatgtgaggtaaaatgagaaatcagtgcctgcttaccacttggcatgattgactgaaggtagtgtcttcactcaatcatgagttgcagaattcaagatggcaaacagttgtgaggagcaaagtcaagaacgtgtttgattttgaggtatctgtaagtgaaaaatcagaggtgaaaaccttacctctcttgaagcagttgtgaatgtaaatctaaggtttggaaaaagatctgggttaaagatttaaaattgaaggacatcaacatggaagccatagaaataaattatattacacacaaatttatgtcgttatttgaatttctccatggtccactcagaaatatatctaaatgtcaccaaaatgttacttactgtagtacagaattggtattaagtgatactattgtccatgttattcaaaaagacagttatagggaccctcttaataaactaattgtgaaaaaggcaaagaattagcaaagctttggcataaaattcatatcatgggccaggcgtggtggctcatgcatataatcccagcactttgggaggctgaggtgggcagatcacctgaggtcgggagttcgagaccagcctgaccaacatggcgaaaccccgtctctactaaaaatacaaaaattagccaggtgtggtggcacacgcctgtaatcccaactactcgggaggcagaggcaggagaatcgcttgaacgtaggaggcagaggatgcagtgagctgagatcgtgccattgcactccagcctgggtgacacagtgagactccatctcaaaaaaaaaaaaaaaaaattatgtcatggaaaaagtaaaagtctttgcataatgtatccaagatcatgaaaaactcttttcaataagataattagttccttttcttatataaacatggaaattttcatttttccttttattctcatattgatactataaaaaccccatcctcattcacaatactactgtctctaccctcgatagataccagttcaattgaacgtagcatgttctacccatgaatctattgttcagtgagaacctctgactataatgctcaggaatactcaagactcacatgattgtcttcttgctatatttagttactttattattttccattttgggaccctgaattcctgtagatctcagagaaaatccgaaatgaaataatgaaaataattaaaagtttagaaaagggagtcaatggggacaaatgttcaggactggtcttttatctcctgcaggaagaaagactgaatgcagaaaattagaatccatttttcatccagtcaccccaatttaatgcaatatgagtttagctatttgattttaagtgttgtaccgttttggaccatgttaccatggtaacatgaaccatgtctcattcatacgtaaacatgttaattgtattaaaacctttaaaacctacttctggatgttgccattacattaaacaattatctagaatgatacaaagtaatgactaaattgaataactttgtaaattaactattggattttgtaattttatatctataaaccaaaagaaaagcccacattggtaagaagacactgtgcatactgaaaagtcaattttgttagcctccaataaccattgtgttttattcctcgcagagcttttgtgaggatcttataagggaataaatatgaaagcactttgaaaaagctttcaagtgaaaggtccttattaattttatgaattaccattaaacaaaagtcaaactgaagatgtaaatctaataggatgctcttaaaagtcaatggatcaaagttatattaattaataaagaataataactaaatattttatgtttcataattggcaaagtatctttactgtcattttctaatttgatccttagtgaaaacctgtgatgttggtactcctattatttccattttcatttgagaagaataaaattggagaggttaagtaatttatctattgctacttgttaaaataactactaaattttattactcccagttaggagggcaattatataaactaaaagcttgtcacaataaatgtttacttttctgggattaaagtcatcatgtatttttcaattattaaggggggtaataataataatagctacctttttaaaatagttactatgtgccaaggtgtgtactaagtgctttgcttgcatgatgtaataccatcgtatatttagtacagaggaaaaactgagaggctgggtaacttctactaaggtaacacacaagtactggttgagtatcccttatccaaaacacttgggaccacaagtgttatggatatcaatttttttctgattctttttttggatttcagattttttcagattttggattacttgctttataattatgggttaagcatcccaaaccccaaaattcaaaattggaaatactccaatgagcatttactttgagaatcatgtcggcgctcaaaaattttcagcttttagagttttttggattttggattttcagatttgggatgctcaacccgaatatatagaaaagtcagcatttgaacctaagtttgactttctgatcttctaccaactctactgtcctacccattactctacattgactcagcattacagggaaagacccaagatcaccaaaagcaagcttcaaatcactcatctaatagaaattagtggaaatatttctacttcctaaacatccatctttcctttacattttaaagtcaagtttctacatctgcctcccaactgaaacacttctctatgaaatcaccataactaccaaatgcaaatatttttatcaagtcctcattgccctagaaatctactcatattttgttattactgctcactacagcctactgaaaaatgtctcaccttttgacttgccagggtgatatattatactaattgtctccttgtctctctaagcactcattccttcctctttctttcttctttttttttttttcacttttattttaagctctaggggcacatgtgcaggtttgttacatgggtaaattgcatgtcatgggagtttggtgaacagattattttgtcacccagataataagcatggtacctgataggtagtttctcagtcttcaccatcctcccaccctccaccctagagtagatcctggtttctgttgttcccttctttgtgttcatatgtactcagtgtttagctccacttataagtgagaatatatggtatttggttttctgttcctatgttatttcacctaggataatggcctccagctccatccatgttgctgcaaagaacataatctcattcttttttctggctgcacagtattccctggtgtatatgtaccacattttctatatctgatctaccattgatgggcatttaggttgattccatgtctttggtattgggaatagtgcagcaatgaacatacagctgcatgtgtctttatggtagaatgatttatattcctttgggtatatacccagtaatggcattgctgggttgaacggtagttcagttttgagttcttagaggtatttccaaactgctttccacagtggctgaactaatttacattcccaccaacagggtataagcattcccctttcttcacaacctcaccagcatctggtattttttgactttttttttttttttttttttttttttgagacgaagtctcgctcttgtcccccaggctggagtgcaatggcgcaatcttggctcactgcaacctccacctcccgggttcaagtgattctcctgcctcagcctcccaagtagctgggattagaggcgccttccaccatgcctggctaattttttatttttagtacagacagggtttcaccaggttggccaggctggtcgcaaactcctgacctcaggtgatgcgcccgccccggcctcccaaaacgctgagattacaggtgtgagccaccacaccaagcccacagtatcaattctatgcattcttttctgatttcattaatctcattatcttcatttgatatttagtcaatagttactgtcagttatgtgttagttattatactagaaacagtcttttctccatctcctttaatccaatgatttgaacatttttattcctttccaatgtctgtcccacatttcttactgtatgtaggacatttcttactcaaatgtctcacaaatgacataaattcagtatgacccaaataggccattttttataccaagtcttatttcctatcctgctgttcatcccggtaccatcttttcagtcagagagttcagatcatatagtcatttctaaatctcccacttacttgcctcactttcaagttcatttttaaggtctgtagattctgcctccctaattctttatgaccattcctttctcactagccccttacctccactctcattcacactcttactattttttaccctcctccactcattcctgcccaccagtggctccaatccaacttgcagatttccatttaaattaagcttcctaaaacatagcttaggttgtaactacaatgcaaattccatgagagcaaagatttcatctgctttattcacttgtatatatccattgtccaagactgtgtgtgtcacatgaaaagtgttcaataagtatttgtcagtgaacgaaaataatatatgactcccctcttcaaacaccttttttgacttcaaagcccttcagaatattctacagactccttcacctggctctccacaattgcccctgagtctcgtttccaatcttatttcttattttacctctcaatgcaccttcaactcctactaaaatgaacagctagccagcttacttctgtgtctttcgatgatcttgttttttgtcttgagattcctttttttcatctaagcttacccaaacattacctacttttcaaggaaagccattttcgaatcttccctttttccctgagcccccaagctggaagacatcttgtctccatctcaattcctataggcatttctctgcactttaaatgacgtttagtacttctgacattgcattagagagaggctggggtggatagtgtttcatagtgtgaactttgaagcccgactgcctgagtttaaatcgtgattctggggcttactgaccatagacgcatttctgaattgctctcagattatggagcataaatcaaaagtaatgacagctacctcttcaggttgttgtgagggtgatgcgaattaatgtactgaagtgcatggaacagtttctggcacacggtaagcacccaataaacatagctaatattatgttattactattttcaggcttatttttatgtatacatatagtatgtaattttatgtcaatatgtataaatagactttggtattgtttatttcactatcaccttgagagcacaattctcatttgatttgtgtgagaaactacttagaaagaaatagacgtgtgaatgaaactatgcttgaaatattggttactgtgagtgttgaaaatccattttgtttaaagaaagcttcaattgttaatcttccataaattttagttcttaagcgttcatattgactcgttttggaaaagctctttaaagtcttgggatataaacaaggctgaataccctcattcatgataacaaacatattatactgaaaattgtaagagagatattttatctttcataatgccctccttgggaaaatacattgacttggcccttctctttcaatcagacaccaaagttgagattgcctgaaacacagtttggtaaaaggagtttctttttcccaaacatcctgagtaacacaggaaatcacaccaatgactgatagataacgttaataaaattaataaagttgttttaaatgcataccatggggcagtggcaatgaaaacattgagaaggctgggactatttgccaactttctttgatctccattagaacctggacaagatccacataatttcagaacttcttctccaaacaagaattgaaaaggtcaggaaaagtttgaccacagaaaaatgtcaaagaattttgtgtcactttctcctcctcccttcctctaaccttgaataattttttagggttattggtctttgggagcagactttctagaccaaaacaaaaaaaatgatattcctctatgtgataggtaacaatcactacccatcctactggaaaattctcaaagtgtaaattgaggggataaaaaaagaatcttaagtcctttaaattatttttaagatgaactacattagtgcctctcttgtgcctttcataattctgataataaaacattccaggtattagtcaaagattaatggtattgaaaataatttaggttatcagcatgtgattttcattccacatgaggtccttttgcagtttacatggttttctaaattatattaaaataaaatgtcagaaagttcacatttttttcatgtttaacagcatcaatctttaaagaaaagttattgcacaaaggtctgtgcataaatcagccattctccgaagaggtaaaagaagtcattacgcctggttatgagagagagtttcatgaatgtaagagacataaatcatttcccactggagatcatattagtctagatggaagaatgtctgtttcttgatagtgagaaagcaacaaattacttttgtttgctcctgagtctgtggttgtccttgagaggtctgttagcatgttgactattgactattcaatattagcattataataacttacaatgatctgagtcacataaatataatctttcagttctctaaagattttactttttcctctctaatatctattcacctccaacacctttgcaaatatattattctctgggagttacaaagaaagttattctctgcaggaagcagcatttcagttgctctcaggagccaaccacatttcacctcaattctttgctcccaattcaacaattcaatattggattaaattcaaggctgtgaccccaaatagaatgagacctggatatttatgaaccacttgaccaggcattcttcccatgatttactccataaatcctttttagtttttgcagtagctttacaaatatttggaaaatggctgtgcaatgcagttttaaaaagtgcaatgagtagaggtagcttcttcacctggtatggtaaattgttgattctcttttggagtggaaaacaagtgttcttatttggatgcaaccattgcattgattagacaaccctaaattcatctttcatccatgacctgaaagaaattttgaaattcatgcaatatatacccgtagtggaaaatgtactttttgaatggattcctgaatgtgacttttaagaagagctattaagaagtgggatcttctacagaacagtaaacaggcatgaaaatatacaagttgataagatatggaactaccccaaaagaggaattaatagtggtggggcttggggcaggaggacagagagacctagccaaggaaggaagggctatattataatagagtacaaagtcctttagtcatccaagagaaggggcaccttctgcatcccttatgagtaagatcagagaaggtattctagttaacttttgctacataacaagccagcccaaaacttcatggcttcagtaaaaattacttgttttgttcatgaatctacagtttgctcaaggttcaatggggcttgcttatccctgtttcagttgatatcagttggggtagattgcctgatgctggaggattcacttccaagagggctcactcacatgcctggaaaataggtgctgactgtcagtttttcttcatgtggacctctccatggagcagtttgggctttttcacagtgtaagagttgggtcccaagagcaattatcctaagggacaagaaattaaagctgcaagcttctcaaggcctgccctaaaagcaagaatggttttgcttctcccatattctatttgtcaatcagtgacagagctctgattcaaggggatgagaacataaactccacctttccatggagaagtatcaaaaagttttgatgccatttaattaaagctgccatacaaagtttcttataaatgacactgagctgaatgaatactaaacagcaagtagtcattatcccagtcaagagaagttatctttgctcagaataccctttctctccttgtctacctggaaaattcaactcttggccaaagccctacctcttctcgaaagcattaccaggccttgcctctaagtgtacaattggagatacaccagtatactgatgtttttaaaactttaaacttttttctacaataaaacataaattaaataacttcccttctgacttaaaagctgcaaaatgctcatgacagtaactatataaattaaaattaaatcttaagcacgataaatacctctcgaatagcaacatagatgcttacttctttatttcacttctttatttgcttttctttgtctatagtttgccccaaaggtattttaataatatcgggttccatgtataccagtgtgtaccaattaatatttagaatatacctgttaataacctcatttgcatagccctactaatctgagcacagcgcagccttaagaaagtcttagtttttctcagtttagttcatctctcttctcttctcctcctgtctctcttatttcctatttctttttcttttcaagtgactttcaactaagtagaaaatgcatttcacatcactatgccggcctccaggctctgtctatttcattcacccaggaatgccctttctgaatgctttctctcatttagcagctatctattgaagttggacaaatgatagaaattcatttcttaaagagccagaacatcatcttgaacaagaagttaaaagaattcagcaaatcaaaagatgagctaatatgggtgaatcttagaggcattatgctaagtgaaataaaccagacacaaaatgaaaaatattgtatgattccactggtatgagctacctacaacagtcaaatttatacagacgtaaagttgaaggatgttaccaggagctggaggaagaagagaatgagggcttattgtttaatgagtacctgagtttcagtttgggatgatgaaaacattctagagatggatagtggtgatggttcaacgataataataatataatattaatgtacttaatagtactcaactgtatacttaaaaatggtcaagaaaatggtaccccgttatcctgatgtgattattacacattgtaggcctatatcaaaatatctcatgtaccccgtaaatatatgcacctactatgtacccataaaaaaaatttaaaggctaaatggccaggcattgtgggtcacttctgtaatcccagaactgtgggaggctaaagcaggaggatcacttgagctcaggagttcaagaccagcctgggcaacatggcaaggccccatctctacaaagaattcaaaaattaactgggtgtgggagctcatgcttgtagtcccagacacactggaggctgaggcaggaggattccttgaacccaggaactggaggaagcagtgaatgacactgtaccccagcatggtcaagatcccaaatcaaaaagaaatgattaaaatgatcaattttatgttgtgtatattttgccacaatacaaaaatggggaaaagcctattcgcttttaagtatccttaaaaaggcacagcttcttcagctaacagactctaaaactttttttaatagaagtattaaggtatttagagagtgcaaaatatcttattttaagtcaagaagttagggtcctgttcctaaacactagcctctgtaatcctggggaagtcagtgctgttggagatctcaggttgatcttctgaaaaatgatggatctaggtaaaagatatgtttctccaggtttacataccacggacaccatctttacttggaaactttattaaaaatgcattgtgtcagaagctctctggggatgggtcgtggaatctgcatatgtaaagagcccctaggtagttcttgtgcccacttaaatttgagaaccactagaccagatgttttgcttatggccctttcagctctgaaatttgaaaaaaaaaaaaatgattctgcaagacagagtctctgtgcttttgcaggataaagaaatgaagaaaataatacttcctgcttgtgttggagcatttttttcatttggtatccccatctccagtggctagccaatcaagaatagtattgtttattcttcccactgttttgaagatacaaaaggaaaagctaagccagatgacacctaaaggcttccattaccattttcatgtttttccctttgcataaaaactgtccatgcctccatcagagccatgatcactagtacaatgttacactctaatgactcatgacattaaattatatcttagcctaatatgaccaaattacaatatcagaataaaaatttcttttttcaggttgaatcccataacttaatccaattataatactggctgaatttttcacaattatgtctcagtcttgatttagggaatcttctctttatcataaaaatgcattttgttaaacatgtttcattataatcaatttctcaaaagtaaagttaatcaagagaaggaaaaaaggttttgttttgatttgatttggaatgtgtatgtgtgtttactgtattgaaatagattctgtctgaaagactgtatataagataaaaagtacagaagagtagtcagagagttattacccacccctgactgatggtgaatagattatctaagtatcccgtaaaaggcacaactccttcaggtatattttacaaattaattagtaactttctagccaaatttgtgtcttaaagacaccagctagaacttggttagttctagcaaagaagattattttattctgaaacaggtttttgttgtcgttttacttatttgaacttttttcttgaatatgtatttctttgcacataaaatatattgacttatgaatgtgattaaaatggaaaataattagttgattttagagagacagagagaggagaagagaagtgtgaaggagagagggaggatagaaaggagagagggagaacaggaaggacagagggagaatgggaaggagagggagagagagagacagagagagaggaatggagtgggtaataagcaagagaaaaatgccaatcatatgctttgctagtgtgtaaagtctgataacccaagggagagaggactactctggcctagtgaaacaaaggaaagagaaatatggtagaatattctcctggtgcttcaccaaatgtgacaccagaagtctgacagaagtcatgtcagcatttgagctccataaaactcaggctatcgacctaccatgtgagagtctcaaaatgagtttaggtaggggcagaggagttgaaatccagtaacatatgcaacagtgatcacaccaggattgcacatagaaagcaaattagtcctctaatagagacgccaatttgaaattcaccctctgagcaggtttttaagcacactcttcttttacttttctatttacaaaaatggaacaccaccagaaaaacaagaatttgaaagacgagatgagaaaagtaagttgtaattggaaacagacagaatgtgtacacaaacacacacacacacgcacacacacgtgcatgcacaggtgatgagagagtagtttgcctacatggtgtatctgactaagaagactttttgctctggttgtcttacaggaagtgactaaatctcatgatgtgaaatattttcttgcatattgtattggaaaagaaaataattttcccaaactccttaggggcagtgttgtcttataattcccatatagtatatgctcttcaagtaagtaactccagagttgagtaagacaagactcgtgactcagatggcatgctctgctccctagactagacattgcatcagtctgcctatactcacatccgctgttaaaggattgcctccagtaaaatatgtcttttaattccttatacaagaatctggaaaaaaaaagtaagattctctatttcttaaatttagcagcaggttaatcactgataacaataaaaatacataacaatcatctagcacgggtaaatattgtggcaaaaattacaccctgaagaattcagtcaaagatataagtaagtacacatcattgtcatgttccacaatatatcatctgctttaaagaaactgttatgtagctgtagtagatttaatcattaatcccatttcttctccaccttctgcaatcacaaccttaacaatgcctccttatgagtggaatgtacttcccaacccctagtcttaggggttggccatgtgatttgctttagcaaatggtaaatgagcaggagtgagaggtgacagttttcagcctaggccttaagagatctatacattcctgtttgtgcttctgctatcattctgagaacacgtccatctaggctgctggtctcaggaaaacgataaaagacatgaacagcagggctgcactagccattcacatccaggaaaagaaatgattgttgcataaagccattgagctttattctacattactgtgacaatagctaattgaaatagtaaatatactttggtttttcctaaatgcatattgaaaattaataatattagccatctgtatgataaaaatataaagcctatgttttattttttaatggttcactgccctaaataaatttccaaaaagtagatgttcccttgtctagtgatgtcattatattttatttatacatcataaacacactgtttatttctgctcatttttttgtaagtaacatgtgttaccgccaatcttgagatgatacacacacttctgtactaaattttggaaaacatattagctacccactccttatatcaaaatattgcctaataatgtgttttgttttaatccttcatgaatttccaggagaactgaactgatacttgggtttgtgagatatatgaaaatagtgaacatgaacttctggtttaacccttgtgatgataatggaatcatagctctgttaattactcttgtggtttgtcttcctagagataatcatgtacaaaattcctttccaatttgttatataatattagaaatacttccaaaattggcatggatttattgttatcatttgttggcacaatcattaaaacgaaacccataaagctagataattaaatgtttacaaagctatagtactcaaaacaaaaacactgtgaaaagagattttttaaataatagtttttgcatgccttttgaataattggattattctgaatttcttcatgtttagtccctgaatctaagtcataccgtctacataaaaatagatgtcagctgaagaaaaccaggcaatggatttgtcttgacgacaatctttttatatgttcagacttcatttaacattagacttgtctgtatttgaaattggtatttctttacatttctgaatttagggaaatggcacaagagaataacattaatttcctctgcattttggcctaatcaaatttgagcctttcaagagacacagccaagtcaattcaaagagacatatgaaaagactactgttaatgtatctttaaaatgaattagcggcatgaactgttgctaggtgagttaggtatagttgtagtttttagtaaccctaagagaagatgcagtgcattctaaaatgtcacaaggagtttgattgctcaaaattctgggagattggctctctgcaaggcttcttgatgtcattgttcctagaggaatgttgttccagtacctatagcgattgcagccataactatttatgtgtcattgtagccattgttattactacatgcttcacatacctctactgaggtctaaagaattagtggacttcatattctggagagaacacttgaagaaccaaacagaagtttgatgtgaatctgcatatccaccattattgttcataggttctcaggattagttgagtgatgccttaaagaaagaaagtcagatgataggtcttcctgctgcccgcaccacatcatgagtgttattcctatagaggaggagtaaagagtgggaagaaaatgaaatctgtcaatactgtgaatatataaataataaaagtagcagtaggactgattaattctgaatcatctttatgaaatgactggagccgtgaaaatgctcagtctgcacagctgattgagaaatgtatgcaatctgttgatcggaatttatttgtgaatgctctcttccagagatttatataccagagttcttaaaacgaattttgtccccatgaaaagaaaactacagatctgtaagactgcaatttaaaatggaagaaaacatgttcccacttgaagaacaactttcaaacaaacaactgatacaaaaaagtcaaaagctgttttgttttatataatagtttcagaatacttccagtcaatatataccttggtttggtgaaaaaataaaaagctaaatccttagatcattaactagaaatttttgtaaaataaataaaagccgtgggttttagtgcagtgatcccatgaagaggaatatattcaccattggtctcttaatctcagatagaatgtacatgttactttattttataacgaaagcaactgtgttgtgatattatgtataatattataacaggagaagtcctcttagctaactcagtaatcaataacattgtacgttgtgtgttattgtaaccaaaaactatgacagaaccccatttcataagatcagtttatccacctatatgatttatatttgaatattcatttcagtacttatgttgcttaaacaaagctactgtattagtccattttcatactgctataaagaactgcccgagactgggtaatttctaaaggaaagaggtttaattgactcacagttccacatggctgggtaggcctcaggaaacttacaatcatggcagaaggtgaaggggaagcaagcatcttcttcacaaggccgcaggaaggagaagcgcccagcgaagtaggaagagccccttataaaaccatcagatcccgctatcatgagaacagcatgggagaaactgcccttatgattccattacctccacctggtctctcccttgacacgtggggattatggaggttatggggattacaatttaagatgagattgtggggtggggacacagccaagccataccaaaaactctgttttttgtttttgtttaatggaaatgatttagaactttattttctgatgtttctttttcataaaaccacgacaccaaaatctacttttcactgctccattcaactagtagagaatatctaatctcttctcaagtatttctttctcaattatggtggttttagctaagaacagcttatggcatgcttttctaaataatattagaacacataaattatctgtacctggtattaccacattcattgctcattttaagatctcaattgatacattcaattcatatatatttaaaattgattcatttagagcaagagatacaggcattttaatgtattacactgctactaaagcttagcaaattattcttttttgtgcccacaaattatcatccattcatgtcctaaaaataaaattgaatttattatactttcccatttatccaaaaaaaaggttttttttaacaattgatgcagatacacattttcaagctaaaaatatgtgtgaaagtggcctctttctcatagtatttattttaggagtctagcaataatttttcttaggttatcagcacatgtcttagcctgaattatttgaattcagtctgtgtcttcaagttcagatggttatgtgatcttgttaagatctcaaagtagtgggaatgatggagtatacaacaacctcattgttttttatggcaactgtcatttactgaaggacataaggctagcagaacatggtcagagaaggaatcaaagtttggtcagccaactctgctccacagctacaagctgctagacaggcataaatttttccaaacctacacaaagggacttagggcccttggctgagagcgacattctaaccacttccttatttatggctggtggggtttgtacattttctcatttctgtataacatttcttgactgtaataagcaatgtattcattctgctttaccactttcactaaccttaacctcaatatatactcaattaagcaattgaaaacagcagttttaatcttttgacataaatgatttcctccgaagcaaaatgctggaaatcccctcaaatgcaccttttattgatgaatacctataagcaccacctacagtcgctggaggctgacaggaaccaaacttgatgataaccactgagctgagaattttcaactcactctttttccctgtatggttcttctagctgcattatttcccactatttaaagctacagctggtgaactattcaaatatttaaactttggagaagaaaatatcaacttatcacaaccctctttttatattctaaattcatatacctgtttggtacttaaaggaaaaatatgctgaggaacaggctggtcataagactgtatagaacgtgcatcttccatcctattgaggtgactcctagacaatgggaaaaatgccttcactcgacttgctcattaaatgtgaccgtagctgctaatcttttggcgctgtctcgaactttaattagatgtgctcttctcttgaaggttggaactacagtatccagagaccatagaatcacagagttgaaaacaaaatcttggaaatcattgaatccacttatcagatgagaaaaaaaaaataagcccatggagatagccattttaaaacatatcattctatttagcctccaatgtaaaacaatgagttactatgtttcaataatgttgatgttaagaaattatttgatagcttcctcacttggtctcctatattcctccaaggttactagttaggaagactgtcattcaaatttggagactacataagaagcagaaaaagcatataaagaggcacatgaaattggaacttttctggtaaaatcttctttcttaaactctcctcaaataagctgttggtggcaggaggtgaaagacagcctccaccctttagcacagtccgtacttgtcagcatttcccaggaagggtgatgtctggaaatgatagagattgtggaagcacattgcattatgggtcaagaatgcgaaggtcaaggagtggagtcttcctttacgaagtagtgttaactgcttggcgtggcattgttgtaaacagaagccaccaggaaggatcatccttaggagggaacctgtagatatgactgaaaacaagagagatccagttttaccactctggaaacataggtaatagaaagcccaaaaggtaccttatcacttgtttgttcctttctgtacaaaaggacttaaatcctttctgagcaagaaagatatttgagaatccaattttgttttaaacttgagcttagcattttggaactattccaaagaccacagaattcacagtcattagcataccacagcagactcttttcaaatattgcaaaccagaacagtctgcttgaaaacctggaaatacgacctagtgggttcaacttgactttttttatttctaacccttacccctaggcaattattgataactcattctggtacctggtatgtatatggactttgttagaagaatttgacaactttctaatcatctgttttttttcttttgcttgatagacatacatttagtagaactttactggattgtattgattataaaccacatttcagttcatatcagtccattttgctgcacaataaacaaccaaaaaaatttaattcagtggctaataacaacaatattgatttattcatggagctgcagtttggtagggtttggccaatcatggctggaaatggtttagctatgcttatctctaggccgtcggttctgttcgggtctataccacatattttcttctgagactcaagctgaagggacatcagctactcggggtatgacagagtagcacaaggcaatgacagaagcacaaacaacacttttcaaaatctctcctcttgtcacatttgtttatagcccattagacaaaacatgtcttgtggccaagcccaaagtcaaggggtaggaaaatactttccacctatgtgaggccatggctggagcgtgaatgtatgatactactagggatgtgaaaggattgaggccaataattcaatcttctattggagacaagctcaacgagttagttaaaatggaaggctaatatttactaactttgcaacccaaggaagagaaagcaggatctctctgacgatgacggaatttcataccctcatctttgaagttatactaaagcttaggaacaaccgtcagataggactgaattgctcccccttccagattcagcatgtgaagtatgcagcatcttattatagcagtagccaaaacagccgttttcttcaatttgggaatacaatgtaggtgtgttaattttcaattaagagttctaaacttattatctgcttggtagctcttccatgtgacagtcattccatctgactcttcatgttggcttttgaactaaattttaaaggaaccgccaaaatttaagggccatgtactttttataacctgtttgtggtctgggtaagaaaataaaaattatacaactgttctttttgaccagccacaagcatgtaatgaaaatgactgttttggctagcagatgtattagaagctttcaaggtgtttaaaaaaaaaaaaaaaaactggagaaaggagccagtgaattgacctcaaacaaaacaagaacaaataaacaaaacacttgtctgcacttccaaggaagggtgatatctagaaaagatagagatgatggaagcaccttgcattatgggtcacaaacgtgaaggtcaaggggtggcgtcttcctttatgaagtagtattaactgcttggcagggcattgttgtaaaaagaatccaccagaagtgaaacaagcagcactaaaagttaaaagatttatgtgtaaacctcatctaaggcaacagaagccatttctataaaatagtataggaccttttattatatatggtcctagagtatattaaaataagtctgtttgggtccatttgcagctcatttgaagatttttataggaaaaacatcctcaaaaatatcatactacagtgccttgatgcttttttctttttataaggtactgccagcccaaatagtaagaaaccgatatgatttttgtccatgtgaggtgtttaattgcttcccaaaatatggttattgtgtagatgtcactaacgaaatatataaagagcagtatttgggaaaatttattttaataccacctttttccttttttaccctaaaagtatttatttttttcgtagcatacactctgtgtctcagtatcattgtttttcataaaaacataaattcttaacagaaaatttcctgcaagctcccctaagcttgaagagacaaaggagatttgtaatgtagctcagccccaatcagggtaaaagaatgcagggctgactttatacttataactcagaaaaaggttatgcttcccgtctcttcacagagctagtctcttaattgattccgaactaggaacatgtacaagtggcccacgatctggaacagactggcggataatggaatattgagaccttgtctatggtcagccatattaacactggataagtctgataacactgtgattacatatgtatcaatatagtatgctgttaatatattaaaaacttatttacaacatgattattggacaactgttacagtacagccacatcaatcctatatcaagttagaccatgtcaactggttttgtgttgagacacctgtgtatggacatagtctgaacttttcatagtttgtgctaaatgatagcaatcaacatcggtatggcacttacagtttactgataactttcatgcccattaacatagtaccgcaataactctgtgaagtgctgaatttgtgtcctgtttcatgattgtatttgtgttgatatctcagtcagtcagagtcccaacaagaaacagatggcacattcagattagggtaagttgaggagtctttatttacaaggcactacatactcaggattgggcagggtgtagggaaatctcacaagatagcacaagactctaggactagcagcagcagagctgtcacctctcctagacctgaagccgttgttggggagagaggtttctcagagcccagaaaaaaagaaaaaaaaaaaaaacatcatgcagattttaatgccttgggaggagcagtggctttctcttaaggacagaatttgcctcgaaatgatactcagggaaaaagagatgaagggaatcaatactctgacccaagactctcccttctctgcagtggtttgctagtcctctccttggtcaaacccaaacagaaaaccatagggcataggagtctaatgatgtaatccaagtcagccccctggaaggtggaaaaagaagggaaaatggatctggatctggagggataccaaaaaaaaaaaaaaaaaaaaaaaaccatagttggcatgcttgtttattgatattttcttgcatgatataagaatccagataaatatagtaagaggtctattttactaacaattttaggcacctaataataatactccttctttgaatgtataacctctagaattggttcagaaatgtaactgtgccgttacaatttctattagtattcaacagtagattcatatccattcatctatgactggagtatctgccatttgctggttagttactgtgtaaggtactttgtaaggtatagaaatacacttggggtgcgatggctcatgcctgtaatcccaaggatttgggaagctgaggcaggcagatcacttgagtccaggagtttgagatcagcctgggcaacatggtgaaaccccatctctacaaaaaatgcaaaaagagtacctgcgcatggtggcatgtgcctgtagtcccagctactcgggagcctgaggtagaaggatcacgtgaacccaggaagtcgaggctgcagtgagccataatggcacaactgcactccagcctggatgacagagtgagaccctatcaaaaaaaaataagaaataaatttgagctcagtgacctacattctagtgcagaaaaaaatgaccatagttgattatgagattttaaagcaataaaccacatgagacatactaatgagctcataagatcattcagaaattgtttattatgaacacatagtactttcagtgtggcattaaacagagatcactgtccttaaacaagttaaaagcagaatcaaatcatctgcaaattaacacaccactaaactttaagcttcttgagtgattctgtaatttttaaaatgtcttcagcatttcagtgtcaagatagtgcaaactcagtaaaagcttgtggaattgcattaaacaaaaccaaaataaatagattttattaaaactatatacaattgtctttctaatcatatcctctccatgaatagggaagaaataattttaggaatttaaatatcttctatcttaatagttcctcttatttccctcttaagcaatgttcactccttcaaaaatatttattgagcatctaatatgtacttaacactgtgccaggtgctgtgaagaatgccaaggaaatagaatgaacttctaattctttggagttccaattaaataacctaaagttaaattggtttcggagagaacattatgccttcgagactgtaggcttctcttgattagaaagtcttaaacattttaagtaactaaacagattaaggagaattcaaggatgcctctcactagtaaatttggattagtctggcaaacttcagaccttaaatgcaagatttttaataattaaaagaagagagaaaatgataattacatttctagagtctatgtttaccattcagccttcttaatcatttcctaagtatatctggtgatcaggattttataactccagaaaatctttctatacatcgcataaatctcttcttttaaaaagctcttcaattttgtattttgttaaaacttaaaagcctccatgaaaaatgagacaaaagtcagtgagaggctgtagcaataaaaatcagatgtgattttcttttgaataacatctgtttttacagtcctttcatgttaaactttataagaatttattataaacagctttattgacagttcaatcctatttctaaaaggatttattttcccccaatggtaagagttttcttttcttaaacctaactagttgcagatatttcagatactacatttctcattgtgtaaggtaaagtttctgaccacctgaatatgacttgtagctcctgagaacaatttgtttagtaccgatatcatgcagtgacattggtacaaaggaattttctttatttcactgtactgttttcagttttattctatagttgttaaataagaccattaaatatttttattagtcttatttcctgtttaactaggtgggtttttgatctctgttcagtaaagcattgtgctcttcagagcaagcaattgaaaagcaaatagtgagtatttctactgtaaaagtttaacattaaaagatatacacacagccaggcaaggtggctcacgactgtaatcccagcaatttgggaggctaaggcaggagaatcgcttgagcccaggagttcgagaccagtctgggaaccatagcaagactccgtctctaccaaaaaaattttttaaaaaatagttggatgtggtggaacacctctgtaatcccagctactcaggacgctgaggcaggaggattgcttgagcctgggaggtcaaggctgcaaggctgcagggagctgtgactatgctactgtactccagtctaggtgacagaatgagaccctctctctctcaattaaaaaaaaaaaaacaagatacacacacatatatttgcgtaggtaactctaatttcatttcaagtatgttatgtaacaaccatttgtgtagtgcttgtaacagtcaatatgtaaatactgactcatcttctttgacaattctacctagatacttattagagtcccccttagtcattgaaaggaaggttaaaatcaaaagacgttgtttgccaaagtaatgaaagaaaacttataaacacaatgtatcatgtctggggctgaactaaaacccttctgatatgtggtattaacagatcatctttcatgacagtaccagttattagaaataaaatgattggagttattattaatactaacaatagtggtattcttaaaatgacttccttatttatcttcacctttatacattctactactgcttcaagacccatcttgaattcttcttccacagaacattctgcattaatttcagccaacattgatttctctttttaaaatttgtcttgcacagtgaattagaaaaccaggaattggaaaaccagaaaagcttattaagtaagaagcagagaggagagagtttcaacaaagggccattctaaagtggtctactgcggacaccatactgattatagttggtgattaaatcttatctttccaactgattataaactcctccagggcatactcttatattccacaagatgcttatctgggtgcagagcatgcatgcagttggtatttgctgatttatcaactaactaaatcttaacatattattattaacaatttaaaataaagttaaatgtatcactctccacccctcaaagccatttctgttctttgttttcatagcaccattattatttcctgcatagtattttttaaaaaccgtatttttaaaatttatatatttgtttatttgggtatacttcactagattgtaagcgtcacaaaagcagaactattataaccccagccactaacacaatgcctaacaaatagtaggttctcaatatttgttgaatgaatgacctacagatattacttcattatgaaagattttgctaagttgttttacatctattttatccaaaactaaagttcttgaggcaaagcctagaatatcttctatgttctcacaatgctctgaatcagtgcttctcttaatatgcatagcaattgcctggagagcttgttaaaacatagattacttagccccaaccccagagatgctgattcagtaggtcccaggtgatgctgctgctgtcagtctctggcgcacactttgagtagtagggctctaggatgttatatgtacagacacatgctgaatagtgggctatgtgcttacttgctggctaaataataaatgttctcactgagtcatagaactttgaaatttgcaaggacttttgctattatctagtctatggatagcaaataacctgataccgtgctatagtgcttgactgcatttaacctgcagaatcctcatgagcagcccagcaccatcactccaagtgaaactactctcttcttgaggttgtccaattctatcaattaaagatgaaaaccaggttctgagagttgaaatctctggacttcaaaggtccaacagcccaggtcttctcaattctcgttagtgtttcagcagctgaatacaaatttattaagctgtatcagagtagtatctgtcaaattggagtgtccataatatgcttaaacagagaactccattccaataacatgaactttccttatgctttattcatcatcgcttgaaattttgaattttgcccaaagaagtttataccagtacatgttaaattacatcatagccttctttgtataaatcttagagtagtttactgaagtacatcgcaaagttttgttgtttcttaggtgattttaattatgtatgtttactttcagtaatgcatcttttctccttcatcaatattatgttatgctagctgtaagtacaaaataattgagaacaaattatgacaaattgaaccaagccacaaaaaaaggagaaaccaaatacttttgtgatttgagcttttttcagtccttgaaactttaagaatatctgtctttattaacttttgctttttgctgatggtttctctcattttattatagcttatagcattgtaaattaatttaacatgaaaggataaaaacgttgcttttgaaatgtttctcattaaattatgaaaaaatattacactaaataaaagaaaggaatgcctctggtaccagcttctgtttgctcaattattgcagtacccaaagtgaattattacacagttaactcagaggcaatattattgtcattatattataaaatagatgagttgcaatcttcaaaaaaaaaaaacagcataggtcctttgaaagtgaaataccttttttccttgtgcttcatttaaatatatactgaccccagttttgtttttgtttttcctttttagagttcttgctaatgatgggcccaaagttatattaagaactgcaaagtaaatttcaaccaattactttattcaggggagtcattaaattgaggtacctctgaaattttggaaggaatgtactgccaattagccgaaagcactactcaatgtcctttctatggttataatctctctagtgtatttttaattgaagacaacctctatagaggaggtgagaagttgctatttattggtacttgttaggatggaatcaagggtgtggaagatattcatctatttctctctccagctcccccacacaaaaagaatggtgcttaatccatctgaagcatttggggagcgagggtaaagatgtaatatttaccatgagccgaaacagatcttcagaagtggaaaatggaagcatattgaagtccctcaactaaacagactttcttccatatggaattcaatgcattaatgttttcaaattctatagcttcaaattcttaatattttcaaattatgtgagcttatgtcaaaacatttaagtgagcttttaacaatgaggcaaatatttgaatcatttgtctacataacaaatactactataaagcatattaaatgttataaaaatcctaatatactaatgtaagctattataaagtacaaataattaaacaatatttatatgatcaatgttttataatacgataaacacattaaataattaaaaactcttccaccgtgcaaaaatgactaaataaattgttaatttctaaggctttttgagattactgtgaaagggggtatagtttcaggaaaggtgaaacttcccttcaatgtgtaaaccattaaagaacataataacctactgagtgtgggtctcaatgatatgccctggaaagtatgggcaactactccacacccaattttgtctttatatgataaggcacagcaaataattataatgcaatggataaatggtaaatcccaccaaagattaaccaatcagagcaggatgaaaattctgagtttggaaatctattggaagatttacagattagattaaagtgcccagtaaccaaactatcaaaattatatggcttcagttaattaatgatttccaaggtttttagtatactgtattacaaaacacattaagcatcttaagcattcaaacaacatttttttgatgattcagaaagcatcacaaattgttatatcagctgataataacttaggtacatatcaattaaacttgtattatagacacgcagaattcttcagaccagaagtcgaaagggcttctctagtttgtttatgctaagttgtttagagatgacataactctgagctaatttgtctattgcaatggttctcaaaatggggggcgggggatatttttacctccaccaagtggacatttagcaatatctggaggcatttttaattattattactggattggagatacaactgaagtctagtgggtagaggccagatatggtataaaatatcctacaatgcataggatagccctccacaaggaattatttaggccaaaatgtcagtagtataaaaattgagaaatgctagtctaatatagtgtttactcacctttcctgaaactatgtcccctttcacagtaatctcaaaaagctttagaaattaaaaaatcgtttagtcatttttgcatggtggaagagcttttaattatttagtgtgttttatcttatgaaatgttgataatataaatattgtttaattatttgaactttataagagcttatattagtatattaattaggattttatttaacatttaatatgctttacaataatattcattatatagacaaacgttttatttttttcactttaacaatgatttttaactctaattacataagaaaaagtatgagttaacaattttttaaattacatgcttggtttgagggccaaatacacatgaaaatgtggactaaaatttaaaatcaaataaaatctataaagtcgaggaaaaagctacttttatgacgaggcatggggaattcttcatagtttttgggttttatcagaagttagctattttttttctttttgctctgtaaacaatcagataagagaggctcaaatgacattttcaagtacatcttaacaaaatacactttgagcatcaattgagtaaagtttcattcttttgaaactttggttttcacaagatttcctgagagttttattttattggtgttctgtgggacttgggcatcataattcttacaaactactcagctcaatctaatgtgcagcgaagctctgggaacttttgttttgtctagtatccagttggaagattctatagctacagagcttgggtttaaaccccctccaagtctttaccagctacctttatgaccctggcaaattacttaaactgtgtgccaccattttctcctctgtaatacggaggcaataaaaatttccacttttagattttctatatgcggtttacaaattgacttactctgaagatcatctggagtaaaatctggagaaatatgatcccttataacttcttcaaccctttatatatttcaacatgagtaaccaatgctctaaatatggatataaattataagaataaaaaatctaggactattataatggtctaaactctcttcatagctaaaagtgttgagtaattaaaccagttgagcagctaaatcatgtacacacttctttgatccctcccacgatcatgtatttggcattgtaatgaaaagatatgtttattttcgagaatagacataactacctttaataatatgatcacccagaaatttttacaaacccctggaaaatttcatgaatatcaggctgtgctcataaaaccttagagatgagatcacaatagactgggtcaacatatagtaatgagcaggattaataaaacctcagatgggcatttacaaatgagtcaaaaccatgagtataattaaataattgtagcaaaaaaagagccttgggtaatcctttcagcaaacgtaatcgaagtgattgcatttagaagacaaatatttaatttggtgactagaaggtcttttattattccattatgtctttgtgtgtgtgtgtgtgtgagacacttttcaaggtcaatttttacttataaattgtctctaattaaaaattgacttggttattaaatcattgaaaattggccatcatcaaattcctcattaaaatatttctatgtgccatatatatatatatatatatatagaatatatatgtagaatatatgtatacatttatttttactttttttttactgtgcctactagagaaatttaaactacatatatgtagaatatatgtatgttttaactagacatactgttaagtacactatacctaatatttggcaatattaataccatctcattgagaaacctggaatatatgcacattttggatgtctattatatgttgggcactggactagtcattgataatacagagattagtaagactcaggttgacttcagccatgttgtcaggaagcacacactctagtttgggacagcgaggagaaattcaataagagaaatatatataaggcataatgctctaggagaatatgcagtggataactgcccaataggaccaggcaaggctttttagaggaggaggtggcatttgagtcaagtgttaaaggctgaatggaaattcactggttgagataaactccttaggaggaactactttaatagaacttgccgttagtcctgaaataaatggtgtgcaaaatcattaccatctgtcaattcactcagtctactttgctcttaacttcagaaaaaaatcagaaatacaattaaaacatttgagcctattttactgtcttttaaaatgagttaattcaaagaggaaattaaatataatgagagagaatctcccccgaggattgggggctggggaaatgctattgattctttgcttgtgtttattttctctcaaaaatacattatgcataaacttgatgatcaaaaattcagattattacatttctaaattggcaatgcaatttattgcatcatacatcaatcacaaaaatgctcatcttgctgactttcataaacttctaaatgaacaaaaatgcaaaaatagtttatactatattacactatagtagatttgttaaactaaaccagaacaatggtccatgaaaaataggcctctgactccaaacgctcacaccacaggatctctctgagatttttgtgtcatttcaagtcagagaaaattgtctaataaattgttggcttgtaacaatgaaaactaagatatctgtggggctattcttgttctcttcattttactacagcagctctgcccagtagaaataaaatgtgagccacatatgtaatttaaatttctctagtaggcacactgaaaaaataaaaataaagaagtgaaattaatttcaacagtatgttgtatataacccaatatacccaaaacattgtcattttaacatgtaattgttacaaaagttattaattagattttttccgttaagtatttaaaatctggtaagttttactcttacagcgcaactcagttcagatcagccacatttcaagtgctcagtagccatatgtgtctagtggttaccatattagaaagtagtttgagagatccacattaaaccaaaaggaaaagaacttccggcccttcactgatgagtcactcttcactgctaaccttggaagcattcccaaatgtagtctacagagtttaaatagtctatcttaacatctctcagggcttcagtcttaatgccatagtatttttaaagaatggtggatattcttttttacagaacactctgtaagagcaattagaagtttatgatgcacgtaatgcaaaatacaggtcatttcccaagcctattttaaaagcgcaaaaactgtagtcatttatcacccctgagaatgttgtcttaaatgtcttggtttggatattggtgatgtgagaactttgtgataagaaagtagtctttaagaataagatatcagactaaaattcatatctagaatgaaagtcttgtttttaatggaagattaagagcaagtctgattcagatcatgcatggggtacactagtctaggaaaacactagtctgaaaatatactaaaagttacttcgcaacttaacaagaaaatgtcttgtgggtgatgtcgttcttgatttttaggcaaacctacctacctttgcaaagcagctgggacctttttgcattggaagaatcatttggagcacaaacaaaattagattatcaacactttggaaaacaactacgaatgagcaatcagaaacctgaccttaagattacttgtgaattgtgaatcagcaaaataaactcgattgttcattgctaagtgtatttcaattatcaagggccttctagattataagtagtcttttttttttacttagtttacaattaagatgtgtggtatttgaaatacatttgccacagggagaaatataaattataattaatttcctaggctaattcaatttatgacatacctatatacattatctgtcatctataatttttcccttattgtttacttcccactggaagaatgaaaatggaatattattacatggcacatggcttgatacttttacaaactctgacaattatgtatttattttgggaggcattgagtttatttgttttatttatataaatttatgaggtacaagtataattttgttacatgcatagattgtgtaatggtcacgtcaggccttttagggtatccatcaccttaataagatgcattgtacccattaagtaatttctcactctcataaaattctaattatgtgaatttaatttaatctatttaatgtgttttaggcaaatatagccggtactataaacagttgattttaagatatcattgcttacattgagactaagtaaaacaaaatgggtcaataaatgtcaatctagataacaatgtcaactaaataagaggtcaaacatggcagtatttttgaaggtgatctgtgaaagtgattatagcgtttacactcatggaaaatgccttcagagtttcaactaagaatgccaacagctcattcctttatcctgatgcatattgtcttccttctcacccccagttccttcttcccctaacccctacccgctttcctttgctgattttgacagaaataggacccccaataagtcagggagatagcaggaaatgggataggatagaacccggaatgatagaatagctgagcctgaaggcatgaagaaaggctcctcctgacatctaaatggagacctaagagatgggttggtcaggtagggggaaggaaacatgaggagtattctctaagccaggcaacatactgtgcacaagtctgaagtcatgggaaagtgattttgagaggattgctgcttggtaaacctagagtttgaattgggagagatgaagctagaaagttagtaagggtcagattttttttttttttacttgcatgacaatggtaaaaaccactaaaggttctgtgttaagcagaggagtgacttcatttaaaaaggtaaattggattgaaatgaagggcataaactgaggcaaaaatatccttcgttaagttattgaagcccagttgaacacactggtggcttaaactggagtattggtataagtgggggaaagaggttaatagattccaagttgaaaaaaaaaaaaaaaaacatagactttgctatctagtaatggattaatatacaaaaggaaaaagtaaagtttctactttttggacagctagaaaccttcaccgaagtagggaacccaagacttagattatgttgggaggggcagggtattttagttgcacagggatttgctttacagaaatgactgaatgacaatatagagagatcaattccattaaaagaagtttgattactcacagttctcaagggaagagtacatactacgccatgcaaagccatgcaggaaaaaagttccagagtcggtcagcaggcagaaaaggaaagcacagcccaaaccctttattgtggtttccaaggaaaagaaatgagtgaggtagaataggcaagtctgagcaagtttaggactggatagttcaaataatttccaaaatttcctggctgtaaaagtggtctctggttgtctggtaccaagccctagggtgaggggaaaaagttagggtgggggaaatattggtttggtgtaacaacagttagatgaagaaggtagttggggatacggactttggattagttggtttgtataacgaaaagcaatccaacaaatccacaagggagcaagtttacaagttatttgctatctttaggaattagctagccctgggaggggcagtctctccctggccttccaaggacctcaagatgttcaagcatccataaaatatggaaattttttaaaaacattataaatacacagagtaaacgctgggcatgatataggacagtggttctcaaactttagctccactggaatctcctggaaaacttgttaatatgcagatgaccgttttacccttaagcttctaattggggaggtctggggagggcacagataatttgcatttctacaaagttcttccatgattttgatgccgctggtgagggaccaggctttgagaacactgatttaggacgtgtcctgtttagggaatatccaaaaggcggacaagttcagggaatattcttgggcagttggctgtgtgagtctgaaattcaggatagaatattaagctgaaataaagatttgggagcttatctacagtcaaatgataattgaaatactgagagtacggggggagagaggtccatgtaccaagaaaagtgaaaatgactaatcccaagcctcgctgaccattgagaatggagctaagtgagaggagttaacaaagctgacccagaaaaagtcataagggccttaggaggccaaggaaaaaaaatacattcactgccaacgagaggcacttacgaatggcttgactggctttgccagcatgcatgaactgcttcataattatttgtattgattacagtaacagatacatattttaacaagcaacttaagtaatacaactgatttttaattatcttgtttaaattgataaaggttgtatatattcatggtgtacaacatgatgttttgatatacccatacattgtggaatggctaaatcaagccaattatcgtatgcattacctcacatacactttatttgtggtgagaacacttagagtatactcttagcaagtatcaagtatataatacattgctgttaactatagtatccatgttgtacaataggtctcttgaacatactcctcctgtctaattgaaattgtgtttccttcgaacaactgatttttttaaataaaaaacttaatacctgtaagttagaattcttaatggtcaccttaggagcctatacaattattcctacgttgttgttactattctgtgtctttttcttttttaacatctttaaaggtatcaaatttttatattttgaaagtagaatttattttttgtcagtctaaaatatttttatgttgaacaaaatgcatgaatggtaaacctagatgcaatcaatttttcaaataaaaaaagtagatacccatgaacatttcttttgtaattgcaaactgtcttgaaaggcagtttcaaaaagagtttagttcctaaattgtaccattactcactgcgttaaaatgcaacattcatttgagcgtataaccttttgatcaatttgtttttgatgtcttgttccctgagagttgtctcaaatagatacatataaatatacacatatctcagattggctctgagaaatgtcttgattcaaacgttcttgattctaagattcatggtacataggaactgtatggtgacaaccttgtcagcctatctttagagtagctttggattctattcagaacatttcccaaagctattctgctatcaagaatataaacaggaatagtcaagggaagctttttaaagggcaacattttcatgtaggcatttttctcacattgaaaactagtttactaaatgcagtgtattaccttctcattacaagaagtctttcacattagtataaatgcatatggcagttgtgccagaaataaattgcctctcaaactagcacatggaaagaagaattctgagatttagcacatatgtagcttttaaatagtatactctgtttcaaacattatgtgttagtccacgttctcttcagccattttcagttgcatttttactttatattcctttgtatatttatctttgctaatcattgtcctgagattcctttagctcttgaattctacgtttttaattaatagaaaactttctttttatttttcccccgacatagttgttttctagaaagaaacagttataggttataaatccaacactttagggccgacttgaacatgcatcaaagctactagaggacttgtagaaatacagattgaatggtcccatgcctagagttttacattcagttacagatagggtaggacctgagaattcacattgctcacaaatttccagttgattttgatggcattggtctagagaccaaaccctgagaaccattaaaaaacaaacaaacaaaaacaaacaaaccaaaaaaaaaactatatacagagattttcttcattggcttttgccactgaagacatttagatgaagagactccacaaagtgtaatcatttagttatgagaggggcctgataatttgcatttctatcaaattcccaggggatactattgttgctgattgagaaccacacttggtgaaacactaattaaaataccattaaaaagcaaaaacaatttaggccagcaaaacctcctaaagaatgaggcctaaagacttattttgttttatttttgccagaagcttcttatgggcaaaattatcaccaacagagctgaggttcaaacttgtgttcatagcaagcaaaagggataatttggaaaaaaagctgaggttagctttgtggttggtttgggagtgggaatgagtagggaggaagaaatttaaaaaaaaaaaaaaaaggaagaagccaaatattaaattgttcacagggcgaaaaaagagaaaaggagtaactagaaatatcttagactggttcggcaagtcgggtccctcgcagctaacagtggtcccaccctctggagtttatatgtttacattctttttttttttttttttttttttgagacagggtctcactctgttgcctaggctggagtgcaatggtatgatcacagctcactgcaacctccacctcctgggctcgggtgatccccccaacctcagcctcccaagtagcagagactacaggcaagtgccaccatgtccagctaattttttgtatttttttgcagagatggggtttcaccagttgcctaggctggtctcaatctcctaggctcaagtgatctgcccacctcagcctcccaaagtgctgggattacaggtgtgagccaccgcgcctcattggagtttgcattctagttgggaaaatagccaataaatttgtgacttattttcctttaaaaaaaaaacttattctggctattgtgtgactataggatatggaaggtgcaagagtatgaggctaacaccctgttctaaattccgtctcctctgagccttgttctgtcaagaatctcctccttctatactttttaagtcaccttcctactgatcctttgctgtcagcttaccactctggtacccttcattttaacaaacaaacaattgtccaagcttaccggtgctgctccttcacccctccacctgtacctagtgtcaattctctccctcttctgatggccaaactttgtgaaactgtagcacagctccatatgtgttcctgcaaaggacatgatctcattcctttttatggctgcagagtattccacagtgtatatgtaccacattttctttatccagtctatcactgatgggcatttgggttgattccatgtctttgctattgtgaatagtgctgcagtgaacatacgtgtgcatgtatctttaaaatagaatggtttatattcctttgggtatataaccaataatgggattgctgggtcaaatggtatttctggttctagatctttgaggagctggaagccattatcctcagcaaactaacacaggaacagaaaagcaaatatcacatgttctcacttaaaagtgggagctgaacaatgagaacacatggactcatggaggggaacaacacacactgaggcctgtcggggggtggggcgaggggagggagagcattgggaaaaatagctaatgcatgctgggcttaatatctaggtgatgggcaatagcaaagacttggaaccaacccaaatgtccaacaatgatagactggattgagaaaatgtggcacatatacaccatggaatactatgcagccataaaaaaggatgagttcatgtcctttgtagggacatggatgaagctggaaaccatcattctcagcaaactatggcaaggacaaaaaaccaaacaccacatgttctcactcacaggtgggaattgaacaatgagaacacatggacacaggaaggggaacatcacacaccagggcctgttgtggggtcgggggaggggggagggatagcatttggagatacacctaatgttaactgacgagttactgggtgcagcacaccaacatggcacatgtatacatatgtaactaaccttcacgttgtgcatatggaccctaaaacttaaagtataataataaaatatatatatatatatctctaggtgatgggttaataggtgcagcaaaccaccatggcacatgtttacctatgtaacaaacctgcacatcctgcacatgtaccacggaacttaaaataaaaattaatcatagaactttaaaaaaagaaaagaaaatgtagcagagctgcctagctcaccttctttacccacagctcacttttcagtccatttatctggctattactcctaccgtgccaggcaaactgctctcactaagaaaatcaatagcctaccccctgccaaattgcctgactcagcttctccttgtaattttctcctttagttctctaacaccctcttccccaggttttcacctgacctgtctccataggacatttgagtctctttcctgatgattcatcctcagcctcttccataataagtatggctgctccccagatcctaccctcagcacttcttcactttccatgccacatctcttctgtgatctcatcttcatccacggctctaattagtatctataagcagatgactctcaaagcatatgctgcctatgtacccctcttggccattctacattgacatctgcaactccccagtgaacttctatatttagaccacaggactggtacctgctgataagcacaggtagggtgtactgagtagtgttttctctatttggttgggcttttgctaaagcagttgtcaaatattttgagtcttactcatggccacagacattttaacattagcatgtcccaaactgaaatcccctactgcctctattctctatttcagaagatggcaccaccatctacccaattatttaagctagaaacttctgattctggtgagacttctctcttttatgcatatgtctacactgacacaaaagactgcaaattttacctcctaagtctgtcttaaagcagatttttctctatgattctctatggtttcaggcccttatcactgtgaagtcaagcatacctgattcgaatcttgtcaccgttggcaaatttttaaatctcttctagcctcagtttcctcataaagttttctgtttcttagggtgactaaagggcttaaatgagattaccatacagagagtaaggtacataaaatgcaattaataaagaatagtcactataactgctgatgatgatgctattactattcgtatcctagaaaactccggtaacttgttcactggtctttctgcatctagcatcacttcctcagccagagttatcttctgacatgaaggctgatgccgtcacccccatactcatgtttgaaattcttcaatacctttaagataaattcccacctccttggtgtagcatgcaaggtcacacatgacataatctctccaaggccccatttcttccactctccttgagtgatatatgtggcagaaaatttaaggctgcctggatattatccaccttacgtcccaatacttccatctgccgcaaagaccttctacccaacttcccatcctcaacgaattcttattctttctttaaaaataacctcaaacttcagactagacctctggtccatagggcattacaaatctctcagtaagttgtacaggatgaacacgccccctaaaactttgtttcagatatttcaatttttattttattttattattattatactttaagttttagggtacatgtgcacaatgtgcaggttagttacatatgtatacatgtgccagatatttcagtgttaaaggtttaataatcacatttacagaaaaggaattagctacaaaatggtggcactggtatacaagtatgtaaagatacagtgcttacaatttaggattattgttgtcgatgttttaatattaaaatggctaatcatacagcaaagtcgaaagaaatttacggtcaacatctgtatacccagcacctatactttgccattgaaattttactatacttgatttattacatattcatctatccatccctctttctgtgatcaatttttaatattctaatactcttacccttaaataataagttatcttttcaaaaaataatgtgtttttacatagatgaagcaaaataaacttgcccttgataaaacaatatgcactgtagtgccttctaattcagtgcattgaagtatccattaacaatataaccagagaatataaaacatgtttattaatattccactgtacctgattagatatagaccattaggaagagttattataattaagaatctaggtttgtcaatatagaaaaaaacctgtgttttttatcccactggaatgtcttgtgaggaatattgttcccctttttctaaaatttaactttgacctttattttgttaatgcaccatgggttaagccacactacgacatgtgctaaatagacctggaagttttcaaactaggtttttaaagtgtatttgacattaaatcttcataacaccttattgattaatttaaatccattaccatggtaaggaaaattcgcagacaggcaggtgaaaattaaaatagaaacaaaacaacatggtaagcaatccttccccccaagccaatcagcatgtagtcagtgtgtccttttaaattagcaaggcgcagcttcccataaagtcccagcttgattttatatgctgcaatagtattgctaaaataaaggagaaggcaacttttctctataatttttttctagaagttttcacgcagcttagtatactgcaatgaccacattactcagttccagaattagcagcattccattgtgaatgacttaattcacattgtgattactcatttaacaacattcttgagggtttacaatgtgcaaagcattacattaagtcgtgtgtggcagaggttctcaaatgcagatgatctgtgaagaagatttcctcaataagcagagaaatgagaactataaggacagaaagagagagagagagaaagagaaattatttaagcttgtagcttgtcatcctcctttcttaggacagcctaccatttaggctgagactatgtctttctgattatttcttgtggttgaaataccccttccttaacaatatgatggtaacagtggatggtaaatcttgttttgttttaatagtttacctggcaaaagtatcattttatgtctgtatcagttatatataatagtatatcagtccattaccaaaccgcctcaaaactcagtagcttaaaacagtaggtacttcttgagttcactaatttgtgggctgatggtttacattgggtagtttatctgctctgactgggctcccttgggaatctggagggtagctgagagcttaagtgtctgaaagtggctgggtcaacacagctctatcgctcacatcttgaacatccctccagcaggctaaccagcccgagcaagtcctttttgtgaaggctgaggtgaagagtggaagtgcaaacatgtaaacaatttgttgagcccctgcttccattaagcctgcaatatccgattggctaaagcaagttttatttccccctgtggtaggcagaatcatgggcccctcgaagatgttaatccccagaacctgtgaatatgctgtgctccctggcagtagggaattaatattccagacggaattaaggttgctaagcaggtgactttgagatggggagattttatggactattcagatgggcctaatctaaccacagggttcatataagtgaaaatggaagcaggagagtgggagtcagagagatgaagatagcccctgctggctttgaagatagagaaaggggccattagccaaacaatgttggtagcatctaatgctggaaaaggcagggaaatagattgtcctctaagcttcttcagaaggagtatagccctgccaacactttcattttaatccatgaaacccatttcaaacttctgacttccaaaactataagataatcaatttgtgttgttttaggccagtaagtttatggaaaattgtcacagaagcaataggaaacaaatatacgctccattgttcaatcttttgaataacacatatactattatttacttaatgtttttcttaaaatcagctcattttgttttctgcttttagccttaagtgataattcccacaaaactgtagtctgatgttgcagtgtttttttccttaatacagataaaactaaatgaatattaaaatttaaactataagctgtttatctgtgtaacatggtaaattggctccctaccactactgttcagcaaaccacattttgggaaacagcgatttaggtggttcaaaggagcaagtgattgtgcaagaacaagaatttattagagaaagaagcatttggccaatgggtagaattgttggcagacaaaggtagaagagaaagacaaattattcagtatggctctagcgaactctttgcacttttatcacacaatctgaagcttgctaatcttgacatgtcttaatgttgttggattgctcattaaactggctgaaatgttcacaaagactctcacctgtcttctggcttaagctgagatttatcacacttcttggaaacatcttctggtctccagatctccctcagctaagctatacagtcagtctgttctgtaagaaagcccaaacttctctgcagtgttcctcagtctttttgatatcatgatgaacagattaagttgatgtgttcatcatgatatcaggtaagctggccgaagactctaagctgcctaaccatcccagggctgagagggatcgatatctgaagtacctataacccaatcagggcatgtgccttagcatacccattggaaagccctgttttagagcctttatcagctgtgaacttattgaaggcaatgattttgtcctgttaatcattctattcataattttcaacaagatacgtggttgttgttaataataattgttggttgaaatgaagttaaataaatagcaattgacttttccaaggtgacgcattgcacagatttatttatcttccctttgctgccctggagtaccagttgtatctaccaataagcttcatttataggccagcctcatcttagtttctgaattagtctaagtggctctggtagcgcatcaaaaatcttgctttctgatggtctttgtaatttgaattctgtgacttacagacttggtattcaatatgtcaggaataaacctggggtgtgcccaaatggtttgaaaaatcccagccttcctgatttcctctcttctctttctcccctggccaccctaatagtctgatagtttttgttatttggatactcctaaactcttggcaatttttcttacatctgttctctacaggctgtcacaagtgagtggaggcaggatggcatgggctgcagtggaaagaccaagaaaataagttaaaagccctgggttccagtaaatgctctgtagtgggatttagggcaagtctcttaacttctctcagcatcaatctccgcatctgtgaaataagattaatgacacctgtcttgcctatacttcaaggttgttttgaggttcacatgcattttccaccccatatagcctataaatctctgatgcctacagataacctataatgttctccagtaagtttaatatttccaggattttaaaactcaatgactagcactgctctgatctaacataacatattgtgtcaatatgtgtgggagtctctctggttgatgttaatggaagtttgtatagtttacctaaaatagaataaagctataatattaatatatatcatcgatgtgttttaggtgatttttttcaatataaaggcaattttggttcaaaattaggtagaacatttaatttttactaatttacaaataaaatgataacatcaaaagggccccttcttttaaagataagttgtaactctcacattgatagtaatctgtcatttaggacagggaatccatgtagtttgaaaattcattggcatcatggagctaaaacagtggctttttaaacatgtcgatttcagttttctttgttttacaagtcaagtagtgatattactgggtacatatgaagcatactgattgaccaaaaaatagtaacaaattttgtaaacccttcacttaaccattattcacctttcccagccacataagaatcctttctctttgtccttagattaattgcctttctttaaccttttcaattctaagtccagacaagctgctgtggttctttaaaaggccacacaaaataagtattgtccagtgctaacactctgaaatgtgatattgtaattactaccaagtgaacattaatcactactagattagaatggaattacctgttatattcacattaatagcaaatgagctttccctgattgatgttgttataatgaatacaaaaggaattaatagtgatctggcactcaccaaaagaggggtagtcattaaggacatgccatcaaaaggcgggtaatactttacaaaaaacaagtattaattaaagtaatatcacaacgaatgcctattgaataacttatatccacattacaaagatattatatggttgcgattaatgtgattgcaatacattttgtaaaaattaataatgactaaccctttaaaatatttaggaagcagatatttgtttatatttgctaaatagctatgccaactctttagcttttgtgagtgacttctagcataggaacagtgatggataatatgaagcactatatataataactcatcggccgggcgcggtggctcacgcctgtaatcccagcactttgggaggccgaggcgggcggatcacgaggtcaggagatcgacaccatcctggctaacacggtgaaaccctgtctctactaaaaacacaaaaaattagccgggcgtggtggtgggcgcctgtagtcccactactcaggaggcagagcttgcagtgagccaagattgcaccactgcactccagcctgggtgacagagtgagactctgtcaaaaaaaaacaacctcatatatttttacttgaaaacatacattttgcctttaggatttttacttgttagaatatcctaaaggacctataattgtaaatgtaaaattgactaatttctgggttttaaaaaaaagtatttgaaagctgatctgctgtgaacattgaaccagatgttaagaaaaatgctagtaagaaatgagacttgggagcaaagaagcagaactaaacttttcatatatggtttctatggagtaattgagaacgtacatattaacagggatacaaagtcaggccctctcattcaagatgctttctgtctttaaaaaaaaaaaaaagtaatttttgaaattttctgtggcaacagtcccatagcagaaagcaaagagttttgaattaagtgatcagaatatcattcttataattttactacactgaacattatttagaaaattttgaatgatattaaaaccgctataaaacatacttgcctaccataagacttaggatttaagccagattaaaataaatatttatttagaaggatgtatgtaagaactggtgaaatataaatgaggtctgtatttgagttaatagtattgtgccaatgtcagtttcctagctttgatgataatgtactatgggtatttaaaatgctatcattgggagaagctgggtaaaaggtgcgtgagaagtctctgtactatatttgcaagttttgtggtcttaaaccatttcaaagtaaagttattttagaaaatatctaaatatatattttagaaagtattatctttttctctgtaactagtggctaattagctcagtctgaaagagtatgtagaggtggaactgctaaatatatttctgatctagacttacttgatgatgcttgaattagtaagtgaatgttatgtgccaacatatgctatgatacatataaatatataagattaaatgataggagctaattatttcttggcatgttgcagtgggtccatttaaaactgtttatgtaggaaactactgtaattataaaaatgagcacagcccaacagcccagtatattagttgaaatataaaaggcgttgtgtccaagatttgaaatgccttacaataagcttggcacttacttaccttcacacaaagcagacacattttattgtgattttagtgttccatattatatggtacagtaccaaaggaaaactctaaaatatgtactcaaaatcctgatgtgcccttctttccaaacaggtggcaccacaatgaatataacctttagagttaatatctgaggacaaacccagcagttacaccagcatgatttaggtcctgctgttacaattattattattgtatttatttcacaattaagttgcagagttgagctcgatatagttccagctgtggcttttttttcaactgtctcaatagttcatagatatggccaaatgttcaataatagtgaaagcttatagtccacatattatttctgtagcaccaattttatgtgaaaaaatgatttatctaaatctcagagaatttccataactagttttgttatacatctacaaaactaagttaaaagaacagagcagactttttaaatagctagattggccaaatccacctcattatcatcaagaagatactgaaacaccgtgtttatacaacaagaccaggcattgtaaaagaggaggaaaggtagagacaaaatttatttagccctcaggaatctttcattctgatagtgtaaatttgacaactttagagggacttattaacatgtatcttatatatcttgataccgaatatatattttgtgattgcattagagccatgaaatattacacaggtcatttgaacatagcattttcatagagaaggtgacatttgcaaaagattaggagaaaagtaactacgattagaaaatcgtagttttattttgtctcttgagaatgaattgatgttaattttatgtctgatttggccaaatacgatgtggaatttgctaaagactgaaaaaagaagagacatcaaatagagggttgcaagttaacagaccatgttataattaaatgagggaaaaaaaagtagagttgttaaactcccagagaagtcatttccccttggtttggtgcatttcactttggtggtgaagtaaatgaccatatgggcacttttctagctctgtccgcaggtagcactgggtatttgtggacaaattacctagcttttcatagcactagtttccttgttgatagacttcagaattctaaattccattttacatccttatttctatgtttaacttaaagataatcctttgcagccgggcacagtggctcacacctgtaatcccagcactttgggaggccgaggcaggcggatcacgaggtcaggagatcgagaccatcctggctaacatggtgaaaccccatctctactgaaaatacaaaaaatcagccgggtgttgtggtgggcgcctgtggtcccagctactcaggaggctgaggcaggaggatggcatgaatccgggaggtggagcttgcggtgagccgagatcgagtcactgcactccagcccgggcaacagagccagactctgcctcaaaaaaaaaaaaaaacaaaaaaaaaaacaaacagatcatcctttgcactggaattatcctgcagtggaggatagtaatgaaagtgtagactctgtttctgaacactagctatgtcactttcaaactgtgtgattttccttcaagtttctcaatcactccaggtctggtttctaaatagaggaataggagtagagattaatattgtgaagattaaatgagaaaacttatataaagcacttagtacggtgccctgcatattgtgaaggcttggtatgttgttagtagattcattttattatcattattaataatactgaaccctggctgttgggggaattggttctatcctcctgtctcatagtcaaaataggttaaagggccttctatctcttatttctggtggtgcattataattactaatagtaatgtgcttcatttgtatatgatcctttatagtttacatggcgctgttttatgtaatcttactaaaatttcaaaaataattttaaaaagccagaattcacaagaatgtgactcggagaagaagtagatgtttttctaagtagatctttcagtttaactgattcaaattttctcatgtttcatatacatgattatcatgtcttttgataaacagaatgttaaccagagtacaaccttgtatgaacatatttattcagcttagaaaagatccagaggtacaaaatctagatcccagtgtagaagttagcatacacagtacaatttctagtatgtccataaacaatatgttaaagtattagtttgagccatataggattgccaatatctgagtgttatagagctacaaaattagtaggaaattttgttgctttaacctaatcattaaattagaattgtgtgacttaaagttacaaatggtttccgaatattttgcagtaaaaaagtagtgaggaaaataaatataaatactaaactagacctgggaaatttaaggctataaagaattctagcttacagagagaggagtctttgtttgcaacctcccactagctaaatttaaattatcacaaatttcatcctctcctttacttaacccttgactcatgcaactagtcaaatgtctttttcttgctaattttttctttccatagatcacttatagggagttctggttaaaaatgatgtctctttaaccttcactaaaatgagaataggggaattaaaatgatatttaccacaaagagaaaaaaatctgggaggaaaaacaataaaataaaaaagataaaaaatttaggaatatgcagagaatggaggagttagcatatcttggaaacctgaattccaagtacttagaacttgggaagtcctagaaatgtgaagcaccagctactgcagaaggcagagatgaatgtgaggtaagatagtgagactgtgaagagaaatcattcagtaaaaaatgcattatcaagccaactgccactggtctagtggagtttaatcccactggggaaattctaaatggattgaagacatgtgtttaagagttagttattctttcaaaggggcaagggagctggggtatttatacacaaaatcctgctagtcattggtttaggactgcttccaacgggggaattattttcctagcatttctggcataccaccttggcaagaaaaattattttgtgtccagagtatgtctaaagccattagggaaaaaaaatgtggatcctcatagttgaaagccaggccagtctgcactaaagtggtaaggatgttttcttttagagatacaggtctaagaaagaaatctgaaggtggttacctcttatgcaagaatttaatttgatggattcaaggtgtgttggttaagagaaatggggaagggttgcttctcatgactgcggcacgattctactatactaaatttttcttttattaagcagcattgccttatgcaatgataggaaacatttgttatatgtgaaatcacttttatttttattttttaatctattcctattcttttcatttttttaacttttattttaggtttgtggggtacatgtgaaggtttattacataggcaaaccggtgtcacaggggtccgttttacattttatttcaccaccgaggtattaagccaactactcagtagttatcttttctgctcctctctctcctcccggcatctcttttaaaagaaaataatttttagcaattctttagaataagtcttggccacctaaaggtttccaggactctagttcagggagtatttatctaagtcagtagttcttaacctgatataatttcatccccagagaacatttgacagtatctcaagaaattcttggttgtcacattgggggcggggatactgctgtcatcaagtgggcagaggccagggatgctgctcaacatgttgtaatgcacaagacagccccccacaacaaagaattatttggtccaatatgtcagtagtgccaagtttcagacatcctgctctaaatcaggactgtgatgtgaattctctgcgatgatgaagatattttatatccgtgatgtgcagtactgtagcatatggctactgagcaattgaaatatagctagtgtgactgtacaccaggtgtgatgttccataccgaggaaagaagtagaaataagatatagtctttgaagtcagagctcacaatctagtagcggagacagatttttaaaaattacaatattttaaaaatattgcaatagaacatggtaatgttagaagattaataacatgctaaatttgaggcatcaggactcagacagacaattaaaaattctctgaggtgaatttccacccttagctcagaatactgtaatgtttaaaagctgttttctatacacacacacacacacacacacacacacacacacacacacccctttaaatcttttatcatgtaactcattgcttcttattttacccttttgtcagagaatacatataaaatactggaatctgatgggacattctactttatttaacaatgctattgagtttctcaaaatagtttcctaagaaagtctattaaagtattgattttttcataaaggataatacaaatggcatgagtctgtttaacattttaatcaagcttaaaattagtcttgcatttgaaacaaacttgcccagagaaattgttgagaaacttaagagaaaaacatcataaaaaattgatgggccagccaggctgtgagaatattaaaatccaaatctaaattatggttaaccattgtcacatctttctttgaagcttaagtaactcgatattccctgtaggatacccagtgattcaaagtgacacatatactgtcagctcattttccttcccagcatgctggtacaatttgtatccatagaaatatatggaaaaacctattagtcttgagtgccagaacctaccaaaaggaatctttgtcatctacaaataaattaataacataagataaacaatcctattaagttatactggcccgaaaagggaaaaaagaccagtttatgaattgacaaaagaaggtaaatgagattagccatatagcaaccactcagataataatgtgttttctctgtttagtaaaaaagcatatttgagagaaaattttcccttatagaacaattcttaataatatacatagatactcctttcctgggatgtagagtttaatcctcccctaagcccctccatgaacttggtaacttacttccagataatagaatatggaaaagtaggaataacaatggagaagaaaccaggcaggcaccaagttaactaagtagtcaagtataacatcgccagtgataataatattgatatcatgtctcctgtgatatgatgtcatgaaaaggacatgttatctctctggtattcttccccaaaacctgtaacttcttctaatagggaaaatacttcagtcaaatcttaagagacttctagaatatacctgactagtcctattcaaaagtttcaaggtcatgaagaacaagaagaaactgagagactgtcacagactagaggagaccaaaaagacccaaggaccaaatgcagtaggagattctggattggatcctgaaacagaaaaatgacatgagtggaaaaactggtgaaatctgaataaagtctgtagttttgttaatagtgttgtatcagtgtttgtttaaatgtttagataaatctctcatgcgtacagaagagttatcattaggggaagctgtgtgtcaggcacttagaaaactttcagatacataggtaccttttgtaagtaaaataatgaattaatgggtcattttatgtctgtattttatataaggctacatttctaaagagacaaaattgtgagtcccataaaaatataaaatgaatatgtgtaaaacattttattagatcattaactgatgaaggaattagtaagatgttagttacagttggttcaaaggagagtctgaagaattggcatatatatatacgtatatatacgtatatatacgtatatacatatatatacgtatatacgtatatatacgtatatacatatatgtgtatatatatattttatatatatacacatatatatataaaaaacactctagaatgctgataggaattttataacagatacaatactgatcactaactgtagggcaggaatctattgcgttccatgagaaaattttactggcatctagtgaacaagaatcatttgtgtcaccatcagccctccacaaattgacttttaaacgtacagaattgcaaaatagcataaccaaagtctaaggtacagactcttagataatcagataactcctaaggttttcctaaggaattaaagggaaagagacattctcagattaaggaaaacaaagaatttcttgctagcaaatctgctcttaaagaatgacaaaaagacattctctaaacagaaaggaaattataacgaagtcttgacatttcagaaagaaaatagtagaatgggtaaaaatgagagtaaaataatagactatcctatttaccataagtttgaagtgaaaactttaacaccacctgatgtggttctcaatgtatgtagagaaaatacttaagagttatattttaaaagaagacatacctaagtggaagtaagagtccttctacacgtcacctgaagtcaattccagtagattgcaatgttaatgcgtatcgtaatgcctggaaagaccactaaaaaactatacaaagtgatacgttaagaaaatacaacaaataaattttgatggaatcttaagaaatgttcaaataacccacaagaaggtaagaaaaaagaaagagaagaatgagaaataaagaaaacaaacagaaaccaaataaggtggcagattgaagccctaatatatccataattaccttaaatgcaaatggtctaaatataccaattaaaagagatttagctgagtggattgataaaagctgagcacacaatatgccgtctaaaagaagtttatttcaaatacaacctaggtaggttaaaattaaaagaatcgaaaaagttacattatgcaacaattaatcaaaagaaagcagcagcagtaatgttaatatcagataaagtaggcttcattgcaaagaaaattactagtgacaaacagggacattacataaagattaagtgttaattcactgggaagacataataatcctaaatgtgtttgcacctaacaacagagcttccaaatacatgaagcaaaaatgaatagagctgaaaaaagaaacagacaaatccatatttctagttagggacttcaacactcctctctcttcagttgatagaactactaaatggaaaataagcaagggtaaagagaactgaacaacaccatcaaccaataggatctaattgaagcactcctcccaacagtagcagaatacacattactttaaagctctcatgaaacattcactgatataagccatattctggactccaagcaacttcagcaaatttagagaattcaacttatatgttcccagaacataatgaaaccaagctagaaatcaataagagaaagacaaaagaaaaacctcaaaacacttggaaatgaagcagcacacctttaaatcattttccccaggtcaaggaggaggttgcaaagaaaaattttttaaacacaaagaactaaataaaatgaaaataaaacatcaacatgagtgagattctgaagcaaagggcaagcatatctactgtctatttttaaagattaagcttccttaagctcagggtttctctcctgtgatgcaatccactgtgtgtacaggtgtctcctgaacttctttgggattactctgtgggaactggctcaataaaatgttggttctttgactactgctttgctgtgagtaatctagtctttttctctggcaaaaaaaaataaagtgagatgtcataaaagcagtattgagaataaaatgtatagcattagattatttagttagaagacaggaaaggtctaaaataaataaatgagcctagagacaaaaaccatcaacaaaatattaaataacatgcgtcaaagtttaaaaaaagagtgtcataccataactaactgggatttagtattgaaggctggctcaacatttgaaagttaattagtgtaatctaccatatcaacaaactaaagaagaaaaaatcatatgattatattgattgatgcagaagcatctgacaacacccagcatccattcatgataaaaactatgagaaaactgggaatagaggataacttccacatcttaataaagggtatctacagaaaactacagttaatagcataattttaataatggaaggcttaatgtttccacccatgattgctaattagggaaggatgcccaatttcactactcttttttaacatagttctggaagttccagacactacaataaagcaaggaaaaacaataaagcatgcatattgaaaagtataaaataaaattatttctatttgtggatggcatgactgtgtacgtagaaaatatcaaatattctacaaaaacaaaagcaaaaataaccaaaaatgctcatggagctgagaagagaggttaacaagatccaaaaatacaagatcaacacaccaaagctagtcacatttttatatacagatgctcctcatcttatgatgggcttacatttagataaacccatcataaagtcaaaaaatcataaggcaagccatcacaacttacggattatctatgttggaaatgaagatgtgaaaagtgaaattaaaaacacaacaccatttataattgcttatccaaaaatgaaatacgtaggtataaatctatcatacatgtacaggatcggtatgtagaaaattataaaatgctgatgaaaggcattaaaaacaacctaaataagtggattatatggcatgtttatagactggaagagtcagcatagcaaatatgtcagttcttctcaaatcaatctaaaggtttaatttagtttctatcaaaatcttatcaaggatttctgtacacatagacaagcatactctaaaatctataagaaaagtcacaggccacagaataactaaaacagtcttttaaaaaggtaaataaagtgggagtaacctctctacccaatattatggctaacaatatagtaaggctatcaatacagtatgatgttgctggagggatagactcatagaccaaatgaaacagaatagagaacccaaaaacagacccatgcaaatgtgcccaacagatttttgataaagttgcaaaagcaattcaatagagaaagctcaccttttcaacaaatggtcctgcagaaattggacatccctagagtgggaaaaaaaaagaacttcaacctaaatctcacaccttgtaaaaacttaattcaaaatagatcatggacttaaatgtaaaacataaaactatcaaaatttagggaaaaatgagaaaatcttcaggctctagggctagaattggcattgaaagcatgatccacacacagaaaaaaatcagttggactgcatcaagatttaaaacctttgcactgcaaaagacctgtgagggaggatgaaaagacaagctacagactgatagaaaatattttcaagccatatagccaaaagatggatgtctagaatatataaagaactctcaaaactgcaaggtaaaacaagaaacaaacaatgcaattaggaaatgggcaagacacatcaagaaacgtttcaccaaaaaggatatacagatagcaaataggtgcatgaaaagattatcaaaaacattagccattagagaaatgcaaattaaaattattatatattcctacacatctatcagaatggctaaaacaaagtagttacaacaccagatgctagcaaggatgtggagaaaatggatcattcacatattgctggtggaaatgtaaaatggtacagccactgtagcaaactgtttatcaattttctgtaaaactaaacatgcagctaccatacaacccagcaattgcactcttggacatttatcttacaacctgtacaaaaatattcataccaccattattcattatagccaaaaactggaaagaacccagacggtcaacaatgaatggttgtacaaactacggtacatccatacataccaggcaatactattcagcaataaaatggaatgaaatatttatacatgcaacaacttttagatcaatctccacagaattatgctgagtaaaaacagctcatctgaaaaggttacataatgaatgattctgtttatatagccgtcttgaagtgacagaattaaagaatgaagaacagattggtgattgcaaggagtccgggacaacaggggaaagagagagagagagatggatgtgactccaaaagggcaacacaggaggcatccttgtagtgttggaactgttctttaccttgattgtgtcaatgtcaatatcctggttatgatattgtactatatttttgcaaggttttaccttcagggagacggggtcaggggtatactggttttctctgtattatttctcacaactacatgtgaacatacaattatctcaaaactaaaagtgtaatttcaaaaaacaaataaaacaattcagaaattttaagacttcaacagtcatttatctcatttgttattttactgttgagaaaacaggcacaaagaaactgaagtgacttactttcatgcttcacctaagtctttttttcttttctccatcactcagttaagagcttctgtaatacagaaagtatgtcttgtattcttttaactcccatattacttcaagcaatgttgaacacatgttaacattgtaaaagttgttgtctgagtaaatgggaaagatagaggtctatgtctatatgcaaatactttgtattaacatgtttcagtctgatataactttccacacagaaagtacaaaagaagatctgttcaagttatctgatttaattaagatagtaaaaagaaagctgataatttagggggtcttatttgattgtttttaattttacttattttccactaggtgatcattttgatgattcaaaaatgaaaatttacaaaaaggtataaaataaaaattatttctcctacctctatgcactgtcgaatcaattcccctacccaccaccaatcagtattgtcagctgtttgtatatccttcaggagatatgtacgaatttcaagcgaatatgcataagtttatgttatgtatatgtgtgtgtctgttttctatatatatgcatctttacattaatggtagcatacgatacacattttcttctgaattatgcttctctctcaacaatgtttcttggacattttcctgtatcagtacataaagaatgtatttgtttcctatgactgcaatagtgaaataccacaaactggatgacttaaccaaaagaagtctgttgtcttacagttctggaggatagaagtctgagatcaaggtgtcaggagggttggttccttctgagggctcggaaggagaatctgttccattccattcccctagtttctgatggtttgttggcaatctttggtgctccttgtcctgtagatgtctgccttcattttcacatggcatgccccctgtgtacgtgtctgtctccaacttccccttttaaggacagagtcatattggactcaggcccaaccaaatgacctcattttaagttgattatctctgtaatgaccctatctccaaatagggtcacattctgaggtaccaggggttaggacttcaacatttaaatttggagaaaatttggacagaattcaacccatagcaaagaacttaaccgttagtttaatgactacatattgttccattttgtggatgtatcataatctatttaagcagtgctctgaacattttattggttttcactttcattgttttgccttaatattggtgtctgtttcatagaatagatttatagtattttaggcttatcaagattttatttaaatcttggaatttaaattccctgtaaatttcaagtgccttgaaggcaagatatattgaggaggggagacttttaaagttcatatgaaataataaataatcgcaagtatctcaggaatgcatgaaaaataataaatgtctctgcatcaataataagggagggggcttgccttatccaatattaaacttgctgtaaagctactgtaatccaaatagtatagtattagcacaaaacaagacaagtagatcactgaagcaaaattgagagtccagaagcagatcagattgtttttggaggccgggcatggtggcttacgcctgtaatcccagcactttgggagtctgaggtgggtggattacctgaggagttcaagaccagcctagccaacttggtgaaaccccgtctctactaaaaatacaaaaattagctgggcgtggtggtgggcgcctgtagtcccagctacttgggaggctgaggcaggagaatcgcttgaacccaggaggcggaggttgcagtgagccaagatcgcaccattgtactccagcctgggcaacaagagcgaaactccatctcaaaaaataaataaataaataaataaatagatacaaattgtttttggaaacattatatggcaaatgtgttattttaattcaaggaataaaggtgttttattcaataaatggtgccagcactctttgcaattcctcttagaaaacacagattgcctcctagcttatgcaatgtaagaatacatttcaaatgcattaaagttttaaatgtaaaaacaaaaattcttggaatgaggaagacgttttctaaacaagacacaaaactcaaaagctataaggaaaaaatataccttgttactgcttaaaataacagaagacaaagtcaaaagaaaaacagcaaatagagtagatgtattcgcaacatgtgacataaagagatgcatatacctaatatacaaatttctcctacaaatttgttaattaaattaatattttttaaaattcaaacaacccagtacaaaactggccgaagtataggaatatgcaattcccagaagaggatatccagatagctggaaaaataaaactatgataatatgcttcctcatagtagtaagggataggaaaataaagaaataagacaccatgtctatctaacaaatagacagaaattaagaatgataatttttaatggaagagagcactctcagatattgcagatgaaacgcaaattgctgtggtctttgaggaaagaaatgtggtatgatctacaaaaattttaaatgcacttaccttttgatcagtcactccatttctgagaatcaatactacagaaataaaagtaccagtatgaaaggctgtatgtagaggatgtgtattttggcattgtctatgatggtcaaaaagtagaaatcaagcaaatacccttcagtgtggaaattattgaatatgttatggaattatttgggcatcccagaatgaattattatttagtctagttagagctgtgtctactgtcctgaaagaatggtgatgatatctttcaaaaatcaaaacaagtttcaattaacatattccatttttaaaataaaaaagataaaattaatcttatgggattacataaccatgaaggaggaatggagagatatatactaggttatcagtatttgttaccttggattttcaaaggagaatgaaagaggaacaaataatgtatcaagtttcacaaaaagtgaaaaggtggaatataaatattactgcaaatatataaccattgaatatgtatatggacaaggacgataagataatatagaaaactgaatatgttggttttattatgaggtggttggattgaagatatttttgtctccaaatactgttgttttaatatgttgtgttttacaaagaaacatgggctgagcagacagggaagccctgataagcatagtacctgccatgtggccattcaataaatgatagttattgattattattattagagttgtagtacagtagtgcctaccttaatatatttagattgatgcccagcagcattgagttaacccgcattttaaggacaagtgttatagctattatatactaatggtaaacttgagtctgtaactagcactgttgaaggaggacaacagagtaatatgatgtgtattggcctggggatggaagggtggtgcttaaggcacagcagattttcactccagccaggtttccttaggacctctccaatgaacaggatacctcccttcctgttctttctaccctcccaccccgttttttgctttttcagtttcagcccaaaggggaaggaagtatgatgactgactccccatcagtccctgaggtgaactgggattttgggagagtgtggcagctgcaaatttggcttcctggagataggatttttgccctcaatctggagaaagttcctgaggctacagctgttcaagcttgtgaagtaggaactttgatcccttttttcaaaagttttgtataattagcatccaacttgttagacagtatgtggctcattacaagattgccacaaattcatgctgggccgtgtctaagaacagggcaaagggagcctttggaaagtgttatacagttgaccctcaaacaatgtgagggttaggggcgctgagcccaacacattgaaaaatctaagtagaacttttcactcccccaaaacgtaactactaataggctactgttgacagaagccatactgataacataaagagtgattagcgtatactttgcattgttatatgtaatatatactgtattcttgcaataaagtaagttagagaaaatacgatgttactaagaaaatcataaggaagagaaaaatatatttactattaattaagtggaagtggatcatcatataggtcttcattctcattatcttcacgttaagtaggctgaggaggtggagggagaggaggggttggtcttgctgccaatctaaatgctgggcccagccaatgggtataagttttaagtgtgcacatattggtgaacccttacagatcacggcactgtctgttcgagtgtctattttgaaatgtccctatccgtaatataagttgcaaaggagtttgtgggcccactgaattctaccaccctgatcattgtgaagcccattcagctttgtgaagagcttatcttggtactaccttagccaaggtatgataactcagacataatgtcttttctttcatggttccttttttagtgatcatagattcagttctgtaataattagagatttatgtgtcctattagtaattgcatcattctttaaagacagtgtcaaccttgctatacagtgtgattgaagccttgacataacttgggggtttgttggcattttgaaatcccaggccccacttcaaaactgttgaatcagaatctgcattgtaagaagatccccaaaagatctgcatgcacaagccttgaaagagaagagaagccatctaacattcctcacctaagatttgaagaatttcccacttatgcaagagtaggggtgtgatttctcaggcaggatatctaacagaaaacaacacttatgaagtgtttcctgtaggagctaagcaggtggccagaaaatggcaggctacaaaggagaagaatgactaggaacctgagcaaggagaaagtctcaaagacaaggaagtggctggcagtgtcagggactaccaggcagctgaaaaagctaggtgtgaacactatttcttggagttttcagcaagtaagaggttcatgatgatgcctcaaagaatttacagtggaaccagagccaagaagtcttattgtggtgagttgggaattagggaaagtgttatacagttgaccctcaaacagtgtgagggttcggggcgctgagccctaacctcaagtaagaggttcatgatgatgcaatcaaagaatttacactggaaccagagccaagaagtctttttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccagctaatttttgtatttttagtagagacggggtttcaccgtgttagccaggatggtctcgatctcctgacctcgtgatccgcccgtctcggcctcccaaagtgctgggattacaggcgtgagccaccgcgcccggcagccaagaagtcttatggtggtgagttgagaagtagggaggtggaaataaggaatggagatgaagacatgaaaggaatttgagaaatgaggcaatagctagagaagaatataggaatacacagatccagcaacccagcaagggaagggctagattctgatttcatgagcaaattgcctactaattaaattcacaatatcagaggaaactgttggactcacttactgaataatagctgaaaagtatctttgctttatagagagatcactgtagatgaaagtcatcttccagtggtgagatattcttcagtgtcatctcttcatttttatttctaatttttcttaatttgaattatttcttctgataatgggaatgatgtggtaattttgtctctcctgtaaattattttaaagatttgtacgaactcctttggcaggcttgagtgtgttgtgacagcttggcttagatatgcattgaatgtcattgaattcaaactccttaccaacatagttagatagcccataggcattctacttgaccctttcaaggagatctggagatgcaattgtaggggaaaaaagaagaaaagaattcaagaagcaacaaagtgaaagataatttggcttgcagaagagaggtctttctatcacagtaataataatgccaattatatgtccatatatatatatacgcacacatatatatagtatatatatatacacatataactcagacataattctttcatagttctttcttttgtgcacagattcacttctgttataattacatacttatgtgacctatttgttagtaattgcttcagtttcttaaaagagcatcaccttgctgtgcaaagtgtgattgaagcctcaacatctcttgggagtttttttagaattttgaaatcccaggccccacttcagaactgttgaatcagaatccgccattgtaagacaatccccaagggatctgcacgcacgttgcagcttgagaagcactgcagtatcacacatatacacacatattcaacaccaaagagagagaaagaggtcataagctctcaggtggagactagttccatgtatatatgcatagagagaagaacaaactctaccttccagcaacgtaaaattctactcaatcatgtattcaccaaaaaagaaaaggctttctccatataatgtgtattattcatatattggcactcttcagagctcttcattccaccctaatgttatctttcttagataattcacatgacactttgttatcttccaataatttctgtcattgttataagcgaaattattcaggctttatctaagagagtaaatcaaacagtatgcctctctcattccaattctgcaatattttcattctagaatgtctaaaggagccttgaaagagaggagaagtcacctaaggccagctagaggggatatatagcagggaatggtggcaactccactcctcgtagcccagtggggttttttttttttccaatctgtatttgtatgtgagtatcacgtctatgccgattttatgtgtacatatgtaactcaaatctgttcattgtgctagttagaatcttatttccccctcttctactacactctaccctttctctttcccctcctttggcaaccaagacactgagttattaataagcagattggagcaaacattttgatgcactattgtttgatagatttgttggttcattcaataagcattaattgagcacttgctaagtgttaaacaatgtactaattgctagatttaaggatgaaaatgataaaacccttggcctctagagcctagagtgtagttggggagacaaatgggcaaattagtcacacgacaacatattccttgttaaaacagacagttgtgcataagtctgtatacccagactggagatgactctgtttccaatgttgccctgggaaacctcatgatcagtttaataatgatgtttggggtgagaggatactgagacagtttgcttctagcatagtaattacccatagaagtttggggtctttattcaaaagagtttacaggccacatgagccactgtcttgccttttataggatcacatctaagttccgtgtcatataatggccttggccttcttggctttctctgtgctctttgcctgccaataccctaattattgaagtactgtctcccgcagctcctcaaccatgagctgttcccgatcctcccagcagctatgtttctcctttcttcaaacctctttagctttttatttgtactttatttgtactaaattgtatttagagctttggagaacattcttcatagttgtaattagactgtaaagtcctgagaatgtatttttcatcttcgtagccccctgcagtatctagcagaatgcctttaaacaaatgggcagtaaataaatcccaacaaacttaaattaaatttctccaaattgcatatttaattttatagtggcatttactgataacatacattgaaataaaggccagagcataatcctctctgtttctgaatattatttatttaaatattaactttctaatccaattaggtctttcaatgacactttagatctaaatttatttttgcattgttttaaatgtcatcaaatgattcatctcttgtgttttttaatatttttggaacgaacgtgtgaaaatgagcaagtgtcatcagaatatgatgcttgggtttttttaattcaacatttctttgatcatatatttaaagactttttctcaattcctttctggatgtggcctcacaaatcatttcagaagtcaatccatttcaagatttttttttttttttttgcttttttcacttcacaggaagtcaagttcattctttaaaatgtagcaaatgattaagcaaattcaacgaatgatcttcatcaactccgaggtgtttttcccccttgaaaaatttaagttactattatttttttttctttttttttttttttgatacagagtctcactctgttacccaggctagagtgcagtggtgtgatctcggctcactgcaagctccacctcctgggttcacgccattctcctgcctcagcctcccgagcagctggtaccacaggcgcctgccaccatgtctggctaattttgtgcatttttagtagagatggggtttctccttgttagccaggatggtctcgatctcctgacctcgtgatccacccacctcggcctcccaaagtgctgggattacaggcgtgagccactgcgcccggccaattattattattttttttaaacttcacctatcataaatcttttaaaatttcacctatgataaacttcctctgtcatctggggaattacttaaatgcaatgatggccttcaagtatactaccaggcagcctatccaaatcatgaaacagaaaggctcatagaccaaattaaaatacttgaatcacagagtttattaaaatcacagtgagaagcaaacgggaaagatatgtgctaagttaacacgcttagaatagagtgtaagcagactgtgaagattagagtacttgaattctgcagtacacaacattatatgtcttgtctgtctctgtattgcatcagccttcccaattatggtgtgcttacaaggaccaaagttgacttcccaacaagggagtccaaaatgggtggtgcctgattcagtggcatgtggtttatcagagacacagagacaagaatgcatggccacagctgtaacttgccaaaatagcctgatgactagccatgtaattctcaggcagaagacttacggtgctggaataggtatcacctatggatgcctgaattaagaccttgtgaacattaagtgctcatgtgtatttatttgatcttgaatatttagtgcctcttgtatatttggtctcatgtgtatttagcatattatgaatatttagtacccaggtgcctcatgaatattgggtatcttttggtccttctatccctcactatctatgtttagtacacacatgctctgcttgctaactacttatcttctaattaacacattccaagagccaattatgtgtatctctttccactgagttcttcattcaatgacatcaagttagttgcttgaaatcagctattgtgagagcacttacaccacagaaattggcaaatgctacaattagcgccactgccctcccctagagccagttatttgacatttactagcattccactacttacatggcccttcatgctctcactccgtgtgaccactcaagccttatccctctttactgaactctacaatcaaataaaatatctttgtttcttgcttctggccctccatcaaatggctccctctcctaggaacaatctgtctctcctctatcacctttgtttagctagttaataatcccttttcagacagcacctcataaatagattcctgaacatcccaaaccggatctcctgcaccttcaatgtgctacttcagtacatttgtcttaccctttgccatatggtatttcaattgcccatgaatttgtattcctgtttagatcttaagctttgtgaggtctttttgtacttttttgtacttccgtatacctaccacataataaatatttaatgaaagcattaatgaataagtaagtgaatggagtgagtgaatgagtattcaattatgattcatttgtatcaaagtgataacatatacttacagggaaaaggccagagggggaaaaaataaaaaataataatatattttatgtatgaccttgtgtggggaaaggaacatagggccactgcctggcctgcttcttttatgcaaatcctaatgtaaaatatgatcaacgcctggctgggcagaaatacaaaaacccagtactagtgattctcccaaccagataccagctagtacagatcatagccagatttaactactgtgaagtggttaggttagaggtgacctataaggaaatgacgctaatgatcattagcatcatcttggaagcttaaaaaaatgccccagctgtaccccaagccaatgatatcagacttttgtggggaacccagatatcattgtttttaatctttaatgattccaatttagccaaagttgagtctcaacaaaccaagttcttcttactctcatattctcttcttctcgcatagataagaattaacagccagctcttctacatgtttcttagacacatatattgtttcagtggtaattcgttaacagtgcatatgtcagcaaagcatgactgaaaaaaatatctgctcccacacattctgatcccatcttgacactgcatagctgttggcgaaggcaatttcaacaatgaagaagtgggagaaatgactacattttatgtaaatatgtattcattgaaaatcaaaaggacatatgtaatgatattgtttaagattctaaatgaaggacaatacttaagagtcctctgtagtcaaatttctcagcagtaaaaaaacattgtcttttctttacaactattaaccatatggctgtgaaaatgttattctacaagcctttaagatttgaaatctgactttatgttaatacacagaatttaccacacaatcctgtatgatttctaagtagatttaaagagtagctattgctcaccttttcaacataatggtaatgatggtgcaatgtcaattacatgatactctcatgggcgtgattatatgattgttaacacactgaagtgcttatatagacatagatactgatttttatatgtacatatttaaaacaaacaaggacttaaaatggcctgtaaaagtctttctagtcagtctttctggttttggacagagaacaaataatcccttacagctgttaggttggtgcaaaagtaattgtggtctttgccattgcttttaatggtaaaaaaaacgcaattacttttgcaccaacctaatagttatctacttccatctttaacgggccctacccaagactgcatggtatataagtaagaaatgtaaatgaaaatctcaaatgctagatctgcccaggaggggaccactaatgagagaggaaatgttaacgtcccatatgaactaagctcagcttagcatttacccttcctgctattccgctagagcagtgcttctcaaaagttgacctgtaatggaatcttctgaatgcctttttaaaacgtagctggctgggccccatccccagagtttctgtgtcagttggtctgggatggggcctgagaatttgcatctctaacaagttctcaggggatgttgccggcccttgaatcacaacttaaaaacctctgctctgaagaaagggaaagctctctctgctggatttccccaagcctttttcagattttcaggagacttctgtgcggtagcttgcttccttctttccatactactactactaccactactactactacaaatagcaacctctagcatattttcagtactaaatacccagcactatatatacatcacaaaagtcccttgaggaaggtggtattatcatctccattctgcggataaggaaatagataagaaatttgctgaagatcgcagagccaaatgagactcaaacccatgtaacccatgtctgtttgactttaaagcccggaatcttaatttgttccagacaagctcattatgtgctctgatcttcaccactgaaatgttctgaatatgaggctgagggcagcagtgaggttggaaggagcagcccagaggagcaggcactgtgctggtagaatagtagtatggtggggcctgcactccctaataaaagaaggggacaatgactatttcctccttctccaaggtcgtgctgcctcccatttctctgtctgcctggtaagaagcagctctgggccatgtgtggtggctcacacttgtaatcccagtgctttgggaggctgaggcgggaggatctcttgagcccaggaaattaagaccaaccctagcaatctagtgggacttcatctctaataaaaataaaaaacttagctgggtgtggtggcacacacctataatcccaactactcaggaggctgaggtgggaggattgcttgagcttgggaagtcgaagctgcagtgagccgtggtctcaccactgcactccagcttgggcagcagggtgagaccctgtctccagaaaaacaaaaagcagcagctctgaaaagaggatctagcagtttctatatgcaggagagcatttgcgcaattgttcctggggttgaatctgagaaactcacagtgcacattcagatactatttacaatcttctaggaatagtataaatattgtggccagggcaccttcatattgtgaaacacaaaaagacttcagaccttagattatgtgtcgaaagttaggcaccaatgatttttttttccatttgttcttaagtggcaaatctttacattaacatttttggtacttgtctttagggaaatttcttctctgttctgaatgtatatattgtaattcctcatttacaattttgcctgcaaatgcaagtgagtacagatcatccagttatgaaaatgctctgagatttgagtctagctgtttcagctttaagagccctgacctagactttgaaactgacatggttttatatgtatgtggttggaattaaacccaaagcacatcttttaaaactctgaggaacttctgtgccacagctttcgctcagttggtgagattttactttgaaatttaagggatgagtctagtttatatgcaaagaaatgtagggagctttgcaaacccaatcaaatcctttgtgaacagtgtgtgcatctgtttattttgctgtcattttgagtccatgatcctgtatactgttttgtgggcacatattgagggtaatatcaaataccatgtagaacagatgctgcaggtatcctttccatgtcctcttagctttggggtggtagatgggcacatggaccaagcccaaagtgacagggtattaacaggagcaagactcaaccaataagggagagtagatgggtacaaatctcagctttctctcccctcactgggataattttgagatatattccaaagatcctcagagcatccccaacagcattgagccccagttccccagattagtaatctactcaataaatacctcttttttttttttttttcccgagatggagtctcactctgcaccctggctggagtgcagtggcacaatctcagctcactgcaacctccacctcccgagttcaagtgattctcctgcctcagcctcttgagtagctgggactacaggcatgcgccaccacacccaactaatttttgtatttttagtagagatggggtttcaccatttggccaggctggtctagaactcctgatctcaagtgatccgcccgccttggcctcccaaagtcctgggattacaggcatgagccaccacgcccagcccaataaagaactctggattgtttcttccttttcctctcctcctttcctgttccctacagtgtttcctaggatcacctcagtctgctgtatgggaaacccagactgagtcaccataacagacagaggcattgttactttaggactttagtggatatagttacatgggagagagagactgtgtatgtatatataacctttataatattaaaccatgctatactcaaattatttactggccaagatttccaatataaattggaaataaattggatataaatcaagaacagttaaaattggaaatagttaaaatacaaataaaatagctaaaattgggcaaaatacctgacccaatgctttaatatccgattgcataattaaacgagtaaagaggaaaggaaattattagcaactctatatttaaatgcaactgacatccaaggaagtcatgaagaaaactctttgtgttgataaactgaaggcctcttctagcagacttctgtgtttattgttctgttgctgactattttattccaaacaaatgaacttgcttgtcattataccccacccttccctagtacagggcccccattctttgaaacagtaactcattcagttccaaggagaatatgaaaagggagggtaatatataaaagaactgaaatgaaaagtggcctaagtgtggcacatttccattgtggattccatggcaatggagaattgatggcagagcatggtgagagatgtgaagcatcaattggctgtatctccagggaattcctgaagttcagttgccaccctggagggtggcaaatgctctctctcaccttccttgagttattgcttagatgactcaaaacaaaaaactgatgagctataaatgggctgtattatttgtttttacctgctgagtagttcagatatttcaaaataatctcaaacttaacctatggtgtggtttctgtgttaaacaaaataccgtaacttttagttgaaaatactgtgtaagcccacacaatctcttgttcacagataatcttgttgtcaaacattcatgatgacaaaaactcataaacgattcttttaaatatcaagaataacttatgctgtaagtcataatttcataagcatgaatttatgaatgtgttttgtgtttgcaattttcatttaggttgtcttaaaatcatgcgttttagcttaacttaggagaaatatatcttttgtgacaacataggatattcagagaaacgtgaaaactaggtgatgtgttttatgaaagaaggcataaagtatatcaagcataagaactttgaattctatttgtgttttttgtggctttagaaaagattgttctgggaatagagaattccatttgggaaacctagcacatacacagtagcagagttaaaatactgacttggagggttcatttgaagaattctatagaatttttgcatgttgggaataggtttatattcttaaacattgcactcagggtttctattcaaagcaaaaataactttgcatagaccttggccattctttcacattctaaagtaatccatttttttttttcagggtagttgttctcagtcctgattttctgataattcagatcatctttaatttacaccaaaaacttttagaagagtcagataataatttaacataaaatgtaaatgactgaaatatacattttttaaaggagcagatatggaggggtccaatgtacttaactatttgctctctttgtctccttgcattcacgggaatgtttctatgtagttttctaatttcacacaatttcaataatccataccctcctcatttttatgggccttcatgatactaaaaatgttaccagaaattattttgtgttagtctctttgtttagcacattcatacataagttttaacatttaactggcatatttttaaagtaatacatgttttttttttaaaaaaaatcagttatgtttgtgtgtgtgcatattttcttttgtggccaaatgttgcacgccctagtccttctatttaaacaatgagtttacataacaaatgttacatgataaacatgaagacatttagtttgaaaaaaaatgattttctagtttactcatttaaaaaaagctgaagtaaccgggaagaggagtggcagaacatattagtctttttcataatgccatcattaaacaaagatacttaatttccaggcctggtgcagtggcgcagcctgtaatcccagtactttgggaggctgaggagggcagatcacttgaggtcaggagttcgagaccagctttgccaatatggtgaaaccctgtctcaaaaaaaaaaaaaaaagaaaaagaaaaagctacataatttccaaaatgacttcagtgggacctgaggtgagggaataaaggctctggagtaatttcactctctattcctctcctaattttttttctgttcctttataacaacattttcactacttttgagcttgggagttgaggaatcatgaccagaagaaaaggaaagacgggaaagatgttcaagggtgaggatgcttaagaatgacctggcaagcttatgaaaatgcagttgtctggatcccaccacagagattctgatttagcaggtctgtggcaaggcctgcgattctgcattgctaaccagctcccaggtgatgacactcatgctggcaacctatgaaccattgagtggcactgttccagggggcagggcaatgagaaattgaagtcaaaagccccaagacctggtgctacgaaaatactctggttccttccctctcaactgatttacttgtcggtgtgattttgcaaaaatccctgaacttcttaaatcccagttacctcacctgaaaagtatgagtgttgctccagatctggaggctttcagaccatgcaaatcgaattcaaaccatgcaaaccattcaagtcattctagaaagttctgcaaggtgcctcagaggccaaagggagagatgggaagagggattgaatgggctctttccaaggttccctaacccacttgaatactttcatcttttatctctttcatatattccacttttgagtatggtttcatttagaaaataggattttataccaacagatttaaagaaaaactccaagtctgaaaatgactcatttatttaaaactgtatagaacaaagacatttagtgcacaattccaaaaattctctgatccttccacagcatgcccagtatgctgcaagagtgccagcaaacacatgcttactgctcacaaatgtgaaatttaaccccatgcactaggaggtccctagtgtggggtggttttagctaaccagactaagagagtacagggcaacatcgagcctttctctgcggtcatgtctgattcattaaaaatccagctttccccgaagatatattaattaccttctgtttcagaatttgtttttagagcctaattcttaattatatctccagccattgtgtgatttgaccattttggaactaaaaagttatcctatgaaattccacctccaactattgccacactgttagtttgtctatttcatacaccatgccaatcttagcgtggtgctagcatttcattataaccagctttcatttttaataagaccatgtgtatatgaaattgtagacttcagtctttgtatgaattgaaagctattaatcttcccagggttaggttatgttaaacagattgtaatgttcttctttttattatgttatttaaatccccttcatttcatactgcaccaatacatttctactatcttggaataaattaattccagttacgtgatggaaaattttagtgtaaaaatataacctgcagtataattttttctgtcagaataccaactagaactggtatgtttcattctaattggaaatttgagttatcgctttgatttttaacagtgggaaaggaaaatgaagattgatatctttcaatagccgttcattcattcttcattccttcattcattcacgtattaagaatagtctatgtgctaagaacagaaagagtgttagagatatgaagattaataagaccagatccctgcctgcaggcatttcctattctatgtcatagatagggggctattctgtttagaggtaaagcatgacccacattgcctctgacaagaagcataatgtctgtagcagctaactgctggagacaggaggctagagggctgccctggtaattggtattcaagtcttcaagaaaggaaaccagctattccaaaatcagtgggcaagaggaagttgtaaagttaagtgaaatgactaaaatatgaataactaaaggttggaatctggtagaaggagaggagagcatcggtcagcaccttagtttgggaaggtggtgtggccatagtaggctttatttagaaagaagcaattcttaggtaccagctaggtttcagttccttaaggggagaaaactggcaaaatataggcaggtttccagggtgcaaagccacgttctagcttcagctcaggcaaggccctggggtatgaatcaccaccagagtagcccagccaaaatgactaagggatctaagctggttgctaatgaaagaggttgcagctcaaggcagctctgctgacgcccactggatactgggattacattgatttaacacatggaaaccacttaatatggtatgtggcacaacacaattaagtactcataaatatttgcagataatgctgctgccattgctgtttttgtcgttagaagactcgggaaaatcatctaatacaggaatccatctgttggcggggcttgggcttctaatatttgactggttgatttttgtcgacccaatcttaacaatattatacacagccattacttcaggaaaggcagttgtaaagaatggtataaatttcctgtaacttgactgccacattctagctgagtcacctctatatacctcagtttctttgtatccgcagtgaagattaatgacctcatagggttgttattagaatgaagtgaattactacactggacttatttaggacagtaactcgcacatagtgagtgctcaaggaaatctcagaccctgcctgctagtggagggtccagctcctgatacatttgggggcaggtttaaggagttcattgatttagagctgtaagggctgatctttcaccctgcatgtcttcagcaactgtggctggtaaagtccagagcagtcaaaggctgacaaatccttgttagaaatcacaaatgcccattctcacaacttctgtggtgttttccatcctttccctagaatactttctttttaaggcaaaggaaagaataatcactgcagatagcacacagtatttttttgcaacatattttcaaaaattatgatgagaaaagtgtatcattcctgtgaagaaacagcataaggaaaatgatttgagaaagaaacatggttcttaaactgaaacaagtgtcagaaggaatcccagaaggcagaaggaaatatagtaatcatgatgaagtctagagctcacaccggttaacagaatggcagcagcgatattcatctcacgcctcttccatgctgtccctgagtgagcttctgctgaattgcctggctggtgaggattggtttcagcagcagaaggaatgggctgccagctgaaggctctggttctgatcctgggtagggtcagagaaagcaagatgtgaccatcacttttgaccttggtcttgaatttgattccatggaacaacgatattttacaaacccagttgaaggtttatccctttttctattcaacacagggagagtccttagagccccaggaagacttagccctttttcattctaagagtaaaccacatctaggtttccagagatgaaaagaccaggctctgatcttccttctggaagcccttgcctattcaacaagcatgagtattaaatgctattgccttggaatcataattcagttttcacagtttgggctatgtcagaaccattcttgtcaaccccctgttttctgagaacccgaaacctgcttgtttagaattttagaatctacttgactcttacaggggagaaaagatctcttttctcacccatcgctaggttcatggctgaggcacctataatgaaggacaaatcaacaacataaaagcatgcgaatttatttaatataagtttcacatgacacaggagccttcagaaatgacccaaagaatcagggaaaagtgtgtatttttatgctctgatttgaggaaaagtagatgtccagtatgactggacaaaggggaatggtaataaactggggtgaccacagcaaggcctgtttctgcagaacctcctgtgtccctgtgttttcagaggtaaaaattttcctttccttccagtatagtaagggcacctctggtatgatagtctcatgacctgcttcaggggagaagggggaaggggaaggtgagagtgaccatcctgcttctgctgtcttctcaaataccaagctgccatattgtggattttggagtagcgtaacttgaatccttttttttttttttttttgagacggagtctcaccctgtaacccaggctggagtgcaatggcacaatctcggctcactacaacctccacctcccaagttcaagtgattctcctgcctcagcctcccgagtaactgggattacaggcacatgccaccatgcctggcaaattttttgtatctttagtagagatggggtttcaccatgttagccggactggtcttgaactcctgacctcgtggtccgcccacttcggcctcccaaagtgctgagccaccgcacccagccgcatagcttgaatcttatcaataccttaaccaaatgactctgacagttttcctcttcttatctaaattcttgagggtcacccacacttcccaatgtcttttgaaacttgacctcttttctgctgaattgaggaagatacctgatttctttaacctcaccaaattcctacttcttactgttgttcattgctggctgaaaatttactttggcgagttcaccaagaacatacttatcggttcactgtttatatttgcactcaagataacacttgaggccctgctactcaaagaatttagtgacaactttcttcatcactctcatatcttatctgtcatcaagtctttttttcctcgtaaaaatgcttttagctctttaagtatgtttcatatctataatagctaagataggctaacagctataatatattaaacatccaccaaatggactattaaaatgacttaaacaaaatagaaatgtatttctttctcatgtaaacagtctaaggtgaattcatgttagttggtgttggatgtgtgtgtgggaagggaggggtgacacccacataattattcaagaatacaggccaggccaggtgcagtggctcacacctgtaatcccagcactttgggaggccaaggtgggcggatcacctgaggtcaggagctcgagaccatcctggccaacatgatgaaaccccatctctactaaaaatacaaaaaatagctaggagtggtggtgggcacctgtaatcccagctacttgggaggctgaagcaggagaatcacttgaagccgggaggcggaggttgcagtgagacaagatcatgccactgcactccagcctggcgacagagcaagactctatctaaaaaaaataaaataaaataaaaataaaaaataaaaaataaattaaaaaaaaaacaggccagcaagggtcttccatctgcaatagccaattgccgaggttgccctcctgaagatattcagccagcccaaaggggaatgagctagaggactgcacacggaggcgtcccatgtcctttgactcaaccttctactggctagaactctgccctgtggccacatgtaacagcagaggggctggaaaatgaagtctagctagatacctaaaaagaagcagagaaaggtttcaagagcatttagcaaccatatccaccttattcatgccctgccctctattcgcagtggccccgcagcactgctcaactagcttgctgcattggcctcttatctcttatctattgccttagatccatctaaatgctctgctactcttatgcctggaatatgttttcaagatgtgactaatcctctcacagcttgaaggataaaaggtcaaactgctctggtgaatgcatgatgcctggtcacctctgtagccccatcttccctgacactttcacagacagtattccctttactccaacctgtgggagtattttctaattcacaataatagcaggaaatacaatgtggaccagacacagttctgagcagtatattaactcatgcatttcttacgataactttataaggttgacagtagtagtatccctatttcacagagaaggaaagagatacagataagtaatttacatatgatctcacagatagtaagtggtacagcttgagtgcatatgactcaaagggtagaggttctagattcttaatcactgtattgtactacttctcccaatgttatcgtacatgccattccgtcttcctggaatacccttcgtctttcttcatctaacttccactcaaactttaaggatcaatttaagcatgccttattttaggtagccatggttgacatcagcctaatttaattgctactcatctatgtccccatagcgtcctttgcattcctctatatctctctgctatagcagtaaatgtaccaccattccgtaaaatccttaagggaatgtttagttttatgttcccaatgccagcacaatgtccagaacagtgttgtcccatagaaatgagagccacctatgtaatcttaagtattctagtagccacgttctttaaaagtagaagtgaaactaatattttattgaccctgatatatccaacatattattatttcaatatgtaatcaataaaaagtattaataaaatttgctttttccattctaagtctttgaaatctggcatgtgtctttcaattgcatcccatctcaatttggacaccgtattttcattgaaaatatttggtctcacctgcacacgtatgtttattgcggcactatttacagtagcaaagacttggaaccaacccaaatgtccatcaatgatagaccggattaagaaaatgtggcacatatatatcatggaatactatgcagccataaagaggatgagttcaagtcctttgtagggacgtggatgaagctggaaaccatcattctgagcaaactatcacaaggacagaaaaccaaacaccacatgttcttactcacaggcgggaattgagcaatgagaacacttggacacagggtggggaacatcacacaccagggcctgtcgtggggtggggggaggggggagggatagcgttaggagatatacctaatgtaaatgacgagttaatgggtgcagcacaccaacatggcacatgtatacatatgtaacaaacccgcacgttgtgcacatgtgccctagaacttaaagtataataaaaaaaaaagaaaatatttggtctctatttacatttcataaactttatagttgaaaaaagaagattcacattcctaagttgttccaaacatacacaaaagtttttcaataactgaaccaagagtcaatttttaaatttatatttaaatttaataaaatggaataaaaatttgttaaacttcagtctctccgtctcactagcctgatttcaattgctcggtagctacctacagccagtggctcctgtgttagacagagcagcacagccctagaacacagtagatcctaaatcgatgtttattgaagaaattaatcaatgacagtgtagaaaatttgcagtgattatgtcagaatcaatagttctccacccattttctcccacactctcaaaagggccaagttttatatcaccaaatgatattcctcttacttctttctgagcagaaacagttttggaaattaagatctttttcaaattttccagactcggcattttagcagcgtttctatttgtaccaacaatgcctttctacctattttccttgcttcttaataagttaactttgtgcgaaggtcattttgtaggtcagtgtaatattgtgcattaagggcttctaagttttctggtattataagaactccttggtttccttctacttttcagaatggaaaatcctcagagcaattttcatctaaaagtgctgcatttaggttgtttcacaattccccaaccctgagtcaaatataggttggtgtatgagcagcagtgtctcttggctaatcaagagcgtctccttttgctacgctcagtgttagagaaatggagaaagtcagctgggtttagagattaggtgagagactcaggcatatcctttgataagtcataaatcatttcctgtttagaaaagcacatgtttagacacccataaaatctccaaatgaagggtgttttacttttccttcaaaatctcactgggaaaaggtacttctgactttccaagtgaataaaaataatgactcctgattaccatgtatgtttaaactgatttgcaaagcaagtgaaaaagagtctagtgagtagtgataagcatcttttagacatcagaagatgtactgatttaaaggtccgtatcattttataactagtatctattgagattcaaatggttattactctgtgtgaatctgtcttttctaattgtttttacttattttagaatatcgatttgtgaatattaaattcctaagttttccagcaatccagtgtttgttttggatatccagcctggatgcagaatagctgcagaaagttatcacaaattgatctctatattctgtttccgagtggcaattgtcaaaaatttggggtcatcggctacccctcccacccctaagaagttccttgtacttcctctttcaaaacactcacatcattgttcagtgcctcacttctctactaaaatgtaaccaaccacaaagatagggactatgtctttcctgtttactggtggattctcagtatctagcaccatgaccaatgttaatagacgttgaatcaattccagttgttacctcttcacactgggacaaaagtccttgcaagtattctgctgccatttgtatagattcaagccaaatatgtctcaaaacgatattacagatgatctcttcgttgttcctctgacaatttctttcccccctgcattgcttaacttgattgacaatgacccctactacttataacatgtgccttttaggtagtgcacttggcactacattttatgtgatagttttatgatgctaaagactatttgctgtgatgatgctgtgttctcacatggcatatccagatttatttatgctggtgaccaaaggcaggtagttaaccttgaaaataggttaaaatttgaaaggcagcaaatcttagggctagaatttataatttatctttaaggaatcttgaaaccaggtgtgaaggaagggacgtaggctagaagtacagaaacctgggttctgctccagcactgatgttaagagcaagttgcattgcttttctggaccttaattttctcttctggaaaatgaatagattaactggaacaaggaaggaaaatacgtgaatggcttccgtttctgtctcgtttacccctgaaagacatggctagtcagtcagctctgtatcagagcacttctcaaggcaatgctccaggtagctaccactcactaatgagagttagcacataggtaaaacctctttgtcatctctaggctacttcatgtttaagatactctccagctttaaaattctaataactctattagactgaaatttaagaatacgagaataatcatccctcaccatgaagagagagtctgaggaaaaaataatgagaacgaataacccttctcttttactacaattcaggactgccatgaagagccgtccagattgtgaaacatacaactcatgatgtgaatggtacttctttgtttttctcggtgtacaacttgcacagctgttcatggccctctgcttccacaaattcatttctaaatagctgtacctcagttctttgacttctagtatgtctaatttaatacacatttctagatttacgatatataagaaatatctccatgaaggaaaaatgtaatagcccatgcttttcattataatagaattttatgaaacaatgtcttttaaaaacagaaacatatgtactactacttcgcaggacattagcccttgtatataaatcaataatacaaaaaattcaaattaccaaggattagaaaagactgctgtgggatatcttctggtgcaagcatacagttatttatccatttctttcatgaatatttattgatgttccaaacattaggctagacactagagacacatcaataaataaaggaaataggtttgatctctatcttctttgatctgtagtttagtgggggaggaaggaaattaaacaagtaactactacaggttgaacatccctgatccaaaaacctgaaatccaaatgttccaaattccaaaactgtttgaatgctgacatgacatcacaaatggaaaactccacttctgacctcatgtgacaagtcacagtgaaaatgcaggcacaccacatagagtttattcagcatccccaagggaagaaagatcctctcagcccccgttagctgtgatatatcttttccacccacacccagattccatcatacaagcaaacccacaaaaggtacgaaaaatggcacatgtgcgggctagacgcgacaacggcaggtaccctacaatgtccagcatggggccaaaacctacgtgcattaatcactgtgtttgctggtatattctctggtggtgtcaagatattgttgaaaatgccctaaaggcctgcatgatatccatagggtaatgcaaatattccaaaacctgaaatttgaaatactttcagtcgcaagtattttggatatgagatattcaacctatagatggtaagggtattactatgatagtgctacgggtgtacatcaaggtaattgaccctggcttggcaggatgcagaaggctttcccaaggaagccttacctcagctgagacctgaagagaagcaggagttagacaggtcaagttggggatttggaggaggtggagtcccagcagatggaatactatgcataaaggcctggaagtgagaaagtcatgtcatgttatttcaagggactagaggaagcttagcaaactggaggcaagaagatagcttcagcacactattgaaattgtccaggtgagtaatgatgatagtgtaactaagttgtgatacctaggtatgtgagctgaacctatggagaaatgttctaggctagagaatctttaattggatatttaattatcagtatatacgtaattaaaaccttgcaagggtttgaaatggttcagagtaaagttcgtagatgagaagagggcctaggagtgaacccaggaaaatggcaaagtttcaggggtaaataaagaaaaataagctttcagtggagacagggaaatttgcagttcagtagataggagacagactaggttcgtgtgatgtcacagaatccaagggaagagaggttttcaagaaaaagtaacatttagaggtgtcaaatactacaaaagcatcatgaaagataagaccaaaatatatcctattaatttagcaacaaggaaggtattgacaacctttatgcaagtgatttcagtgttgattatggagaactcagtaattacttggtggtaactaaagaaccaagattgcagtacgttcaggcatgattgagaattgagaaagtgggggagcaagtgtaaaacaattattttaagacttttggctgcgatgggaagagagaaagggccatagtagcagaagatggatgtaggggcaggaagaacacactcttaaaagggtagtgacttacacatgtttaaatggcaatgagaagaagatggtagagagggagaggttgaggatgcaggagaaattagagataatcaatagcacaggtacttgagaaggcagaaagatgaaatttagaaattagcttcagataggaaggaaagtacagcttctattacaacatcaggggagaagggaaggaggatgggcatagctactggtagttttgtaagtttggtgaaaggttaagtaggattgttgtattggatttattttttattgaagtggaagctgcagctaaatgcccagtgatgaggaaggtgttggagtctgagatttaaggtgagtggcaatttgaaatagctgctctaggatcctatttaacagagaaaatgttgagtacacaatcagtgagcagttttaagtccactctattctgtttgcagtttcaagtacctttcattgcttctaagtttatgaaaactggttcacaatcttcttgtgcttcttatttctacctcttttccttctgttttctcacctccccagtttaaacagtcccgaattttttacaattaaatatacagcaactgccatgaaatctactgataaaagatactgcaaaatcagtttgggattgggttcattagcttacttattattatcaatcctaggccactaagcaaccttgcataaaatgcataaaatgaggagattctagtggaggatagttttcaattatctcattaatttcaggccatgtgactagtccaaatagatattataggccaagaagagcctatcttgagattttaactcccaggataggttttctacctgatcaaaagaatctaataactattcaatctcttcttaaatggtttggttttctgtgcaaacagttttacccttttagctgattttctaggtgttaaattaagaaaattctctcagatacttgttcatcatgtactaggatccctgatgtgttcagagttgtccaactttcaaagggctttgcattcagagtacctaatctaaaccctgatatcattcttttataacagaaaaccccggattagactgggacagtgtctgtcatgttcatcactgcatctccctcagtatttgtagaatgaatgaagggacaatggcaaactatagtcctaccatcacacttttggtagtgaggagaactgctgtaacttggaagattggagggggaaaaggtggctaaaacaatcatacagtaaactgggctgctatcaagagaaaccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttagtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagtttttaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggagttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaaatattgattattgccacaatttcagagcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaactcgacctttctctctggctgcccttaacattttttccttcatttcaacttggtgaatctgacaattatgtgtcttggagttgctcttctcgaggagtatctttgtggcgttctctgtatttcctgaatctgaacgttggcctgccttactagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattcgttattctagttatacattcttctaaatttttttcaaagtttttcaaaagcaatggcaacaaaagccaaaattgacaaatgggatctaattaaactcaagagcttctgcacagcaaaagaaactaccatcagagtgaacaggcaacctacaacatgggagaaaatttccgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatccaccatggaatactatgcagccataaaaaatgatgagttcatgtccgttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaattaaaaaaaaaaaaaaaaaaaaaagagaaaccagtgctctattatctaggtatataccaaggttacccactgcttgactctcattattagccttctttgatgttctctggtacttgatgtctttcataactaatcaatgtattaatgtatccaatcatttactcgataactttattgaaagcaaaagcagttgcataccagctatcaagctggaagtgggagatacagccgcagacaaggcagatatggtcccagcccttaggagctcccagagtagcaggaggtttccccttccagtgtcttctctctgcttttcttcaaaaggaaaaggctgatgtgtataatataccatatctctttgaagttctctgattatggattttaggtttaaaccagttcttcatccatgactttataaattgaaaatccaggattttgctgtgttgttgtgttcttgttttgttttgatgtccctgttttctctagatacagttagaaatgtctaggaagaaatttttggttagtatgggagccccacaaagccatttttttaaacataaaatctgtattacatatcaggtatgaaatacagggggaatgaatcatttctccgtaaaggaaaatttaaagtaaatttcaggaaagtgaattctttcccgtttgcattaccgacagatgcagaaactttaatcgtcatttgctaagagggatatggcagataatacacaatagatgtcgtagcaacattcactcgcattctttttttttttttttaaagaaatctttctttcaagaagctattctaggatctttctcatgacagtgtcctagttcttatctttgctacacacaggctcacaaagtgttttctttgaagggcattttgttattggccctcttttcatttttcttttccgtagcaaacagaaccgaaggtgtttactccccacggtgagagggcacctgggtgcacaaacagtggtgtgaaccactggcctttctctgctttccgttccctgaatgtaagaaacaggtgcagtgatcaattcactgcgtgcagtgaaccccaggcagaaagagaacgtcgtgtcacagaccttttgttacttggagagaatgagcgggaagaaaggctgcctctgctgctactgagacccttttgcccattttattgactgctataggttcatctatcctaatttgtctccggctgtcccagtttatccctgttattcttgtgttactttactttactatattttattttattttattttatttattttagagacagagtcttgctctgtcacccaggctggagtggagtggcatgatcatagctcactgcagcctcaaactcctgagctcaagcaatcctcctccttcagcctactgagtagccaggattatagctgtgcaccactatgcccacctaattttttttttttttgaaatggagtctcgctctgtcacccaagctgcagtgcagtggtgcgatctcggctcactgcaacctccacctcccgggttcaagcgattctcctgcctcagcctcctgagtagctgggattacaggtgcccaccaccatgccctgctaatttttgtatttttagtagagacagagtttcgccatgttggccaggctgttctcaaactcctttaactgtttttttatttttatttttaatttttaaaacatattgtagagataagagtcatgctacattgcccaggctgatctcaaactcctggcttcaagcaatactcctacctcggcctcccaaagcacctggattacaggcatgagccagtgtgcctgaccctgtgtgattattattagcatcctggacactctcaaaagtgttcaggtttggacaatgaactataggatcaccctaattacatgagattaagagtagagaccttgaccaccagaaatggtcaatactcaccatatattttcttcctgatgttagaacctggtacttttgggaaatgaaattgtacatgagatatatgcagaatgggcgaagggagcgaaaagatttaaaaaattaagctcgatttattgagcgcctcgagtgcgctcagtgctgttccaagtgctgacagcagagaggtaagttctgttctccagtgttcacctcacacgtgcaagccaggtttgaaaacacactgtctttccttagtatccctccacccctccatgtgactatacgtatgtatcaagtttgtgatatttcacttctgggcttcttttcatttggaaatttaatgtcagtgtatcatgttttaattaataggacatcatgttatgaaactgttgaatcgaatattttccctaggcatcaaattacttgtcagtggaaatttgacatctagatatgagggacaaaagagatgagaaaaataatagtaaagtgttcctaaaggatgctggtatactgtttaggtattttaatgcactgttacaacctaaagtgtcttgtaaagtatgttctttagaaataaaataaataaaacaagacatctctccataggtacaaatccacttgccttcctcaattcctatccttctgtgatgggaaatctctgctgtgacaaagaaccatgttaagaaaaccataaagttgtattgtttgtagatttttttaatgactaaaggaagatattgcaagtagtagaaacaaatagaggaggtggccctgaaggtcaatataacggagttcactgcagaaaagagaaactactctaggtacgttagacacatatcaaagttttggaaaggctaaagtagcaggttttagacttggcttcgaggacagatttctaaaactatatagaactgatccaataagaaactaccatctccggggtaccactgaagcaatgatttcaagaacatactttgtaaataggaactaggaaccaggaggttgaaatctagacgctaccacttttgaagctgctgttagcaactgcccttctccagccaggaagctggagaaagaactttggaactctgatgtaggaaatctcatgtttctttgactaagctcgccaacagaaatagccaaaaggggcagaaaggtgacctatgcctcacttccactttccagatctctcacaagtatacacatttggcaaaacgttgccagatttagcaaataaaaataatgcatgcaacatacttaacactaaataaaaaaagattgtgtagaaaatttaaatttaactgggtgccttgtattttatctgacaaccctaacttattatatcctaattcataatcagaacactagctgcatggaagtctggcaaatacagtttttaatttccaacctgtccaactggaaggatggtaagtagatttaggtgagccagttcacagtattaaccaaagtagattgcctaccaagaatagctaaagcctttctgcccccagacgcttatgctaccatctgaatatttttactttgcattcttatattcttggaaatcctatcaatctgtgattcagattggtttggtttaactcagcttccccttttttttggagacagggtcataccctgtcacccaggctggagtgcagtggcacaatcatggctcactgcaacttcgacatccctgggctcaggtgatcctccctcccacctcagcctcccaagtggctgggactacaggcacgtgccaccacaccccgctactttttgtattttctgtagaaacagagtttcgccacattgcctaagctggtctcagattcctgggctgaagtgatccacccaccttggcctgacaacgtgctggaattacagatgtgagccaccatgcccagcccctctttttaaaatataaaaatctcccagaatgtgaaagttgtcagtctatactttgggaataagattttcaacagatagaagagaatgaggattaaaacataaggaagtttgggagtagaaaatatgggcaccagaaggtggaaggagagagcagatgcccatttatatatctcctttgttgggtgttggacaaatccaggtcttaaaataggaagtatttcttttccgtacttcttgaatctttcatatcccaaaagatgcatatttcccaaatcatataacccaaagtcatgctatcaaaatgatataaatcatccatggtataggttaaatagctatatatgtatatgctggtctgagacatgtatatgactattgtgtccatggaaatttgagtttggggttctggaccatttatttgcaagtgatttttggttagagaactctttgtaagttggggattgcttttacttattttatgagtaaagatgtcaaaaggatgactgctaaatttgcactgtgttaattcactatttagtgagaagaaatattagactagctatgaaaagtaaaactgcctctccaaaaagtcaaagctgatgaaaaacagtcatacaagcacaatgccgctcttcggaaacatggaaacactttttccttcccaattttccctcagattttctcttccgcatttaaaacacttgggtggttcaagtttctaggctaccactgattgtaacagcaaacagtagcaactggaagcagtgggatgttgggagaagtaatagaggtagctgctacccaagttatcctggaggattttccatggcaatgaaatcaggtagtagaagcttggctaactgagtgtaagcaaacagttctactgagaatggtgttgtcttttcaatccgtttatctgtgatggtgatagtgtgaaacaggggaattttatccaaggtttaaggaaggttatttggttaaaagaggatattgttacagtgaagtcaaactttccattaactttttgctgtaacaacagattgaacgtagcatttcaccgtcaacgagtaaagtgaaatttacagattaacttatgtgcctcttttaaaatatatcagatttctaaattgcttttatttcagaggtatgggaggttcactttctctttgaaagtgtacattatttttctagtgtcttacatctgcctacaaagatgttattttacttgaaagcacagtaactatttgatgagaatttgtcagcatcagtaaattaaagaccctcaaatgatttctactaattatagtttaattccgtacatttaatgatattttaaaacacatgagttatttcataactcccaacatcacaaggataaattttattctacaaacaaaatattgtgctaaatgaaatagttcatttaggcaaagaaaggagcacagaaaattagtggaactctctgctgtaagtaacgtagacattacatggcatattgagtctccatgaatattgtcatgttatgttttaaaaaggtgatcgaacatatggcatttaaaagttccaagtcctcttttaaatgcttcagaatctattatttaatgatcatcttggatctcaaaactgatcttttgaaagattttattcgccccatgtgttaatatgatttccctgtcatatgatatgattatctatcaatacttaaaaccagcagccaagtaaaaaatcagttcatatcatttaatgaatactatgagtcaggatctgggtaggcaagctattttcgggtttgagtagttccaaagcttaaaaatcttatattgattttacagtgaagaagaaatagtcttagctactttggaggtttcaaacattgactactcaaggagtatttccttgctttctcaggcaccaggcagtttttcaggagcaagcattcatccattcagggaattgtaacctgtagtttccacttttctagcaatcacacttaaaaccatgagagtaggccataggacataaggagctcagcttctcagggcaagcacatcctttcagctttcacctgtccgtttgttagtgttcacttccgtgctcaaggagtttcttgttgcctctgagttctaagagacagaacgaagggagaagggtgcagaagtctaacgcatgttcatggacttatctctccaataaagagcttgttttatcttcttttatttatttattttttctaatgaagccattagcctcaaacaaagccatggaatcttatcagagtgaaaccggggtcattccataggctggctgagtgagagctccatggcacgatgatgtatggtcactgcacaacaacgcctttgccacaacacatgtgccttttaattacactttaaatctcatttgaagagatgttatcattatggaaattgctctgtaaatgtgcccaggatgagacccaataaaagtttgctgagaagaattgaagacagaggagatgaatcagcagctaaaacattaccatcagacagaattttcttggctgtaggcaaaacagcccatgcaataacagaaaatcttcattgactcagaggcgtattttccctagattattatggggcactcctgcctgtagcactatcacttctttgataagctgaaggaagcgttctgctctccagctcagcgggcctttttctccccaacctcagagccatcatttgaatttatagttgccaaaatgaataatacagtattgcccttgtgttcctgacttcatgcatgcatgcagagcggggttaaggttctttaaatgaaagattgccttctattcatgcaataaagaacacctctgcttcctttccagggtcatttaaaaataactataccgctgggctatggaaagcacataagaaagattcttagggtaaagtcaaaatgctcttttctctacaacaggcattgtctcatatctttgtgtagcacagctgatttgaagttttcttttaagcacattcttaattatcttttcctttgatcttgaactgtttccctgggctaccagacagagagcctagagccctacctccgctttccccgaggtgcaaactgctccgtccttccacaggcaggcccctggctgaatgcacccttttctccatggttacccacccacctctctgttatttgttacttcccaagtgaatggcaggttaaaatgggaaaaggtcaggttatctgaatgtggttagagtgaaatgaatttcctcattgcacccaagaactgtcctttgacaggtctccttccccaaatcgggtcattttgtacgtaggctcactgggagtaattctaagacaactaaataagtaaaatcacattttggtgccattttccaatgtattcttcttcttgggggttctcctttaaaatggtactggaaggatacgttgtcttcattaatccattgtatgtcccgggggtggaggtggaggtggcagtagcagaagcccgtgaagtaataggtcgtattttgtgtttataaatatttctgcaggtttttgaggagaagatccatcattcttataaaggcattcatgacctccagaagattaagggctgttatgctagaacagtgtttcattcttaaaatggggtctctggactagcagtatcggcatcacttgggaacttctaagaaatgcaaattcttgagttctaccccagacatacagaatcatgatctctcagagtggagcccagcagcctgtgttttaatgagccctctgggtgattctcaagcccactcaagtttgagaaccactgtactaagggaactactgatgcatgatgcaagttcacgctcacaggcacgtgtgaatgacacaaagaacacagacgcctgagagagcaagaaagacaacatagactgtctgactccctgctgggcccttctttaccgcccctatttcaggctaccatgcccatgagtggatgacacgtaccccccgacaaaggtcaacaccactctcccttccacaccctatcactaagtgacaggctaagcctatgttaaactgctcacatctccttggaaattcaacactttaataataggtagcattatcacccccatcttcttctctaagccagaaacccaacttgcctccctatatgttatccttgcattcagtcagtctctaagttgtattcatgatctctcaaaaatatctccctttttctcatcctgtgtctattacctcagtttagatctccatattctcttgcctctaatgttcttgcctctaatgtaccttttcactgccaccaagatgatgttaccaaaaaatcttaaacagattagacatcttcacaggataaagtccaaacccttagcttgatacacaagccccttcacaatccaggccctccttcctgtgcagctatatatatatatatatatatatagagagagagagagagagagagagagagagagagagagaaattttgatcttaccactctgtctctcttcccgccatgggtcttcccctcttccctccggagttacttagctctgatgtgtattcttatctcgtcttatcttcaacttcattcatgtttttcccactgcttcaaatttcactctcccacttctcccctggccagctgctactcatccctcaagaccctgatcaaatatcatcacttgtatgatggcatctgcaaatcttggggggcaaggctaattgttctttgttcccacagggctgtgttccagtttaacatgatcacatgttattttggttcatttatttgcttaagactttttcagaaggctatgggctctttaaaatagagaacttacatcttgtagttttaagagtatttttagtaaaagtttagagtgacccccatctttctgccagcccacaaaaggaaaacatcaaaaagtgaatgtgtaaaaggaagagaactctgacaaaaccaggcagaaaggtttttcagcaagtctttttattttctgttcaggataacattaataattatccacgttggtttctcattctcctgttggtgaatatttttctgctaaatttaaaaccgtatcacaaactcaagcagagatttacaacatttcaacagcttttctacccctgccttagaagggtggatcaaaaacatttgtccatggtaaagcactatggacatgacttagttaacaattctctgtttgggtcaccatgaggcttcttcgtttatactcagggtcagcgacaatgctgatatgcagctacaatttctcatttcttactcagggtgttatgaagcagatttccactgttctttaatcgttattaaaatgtagtccaggtgcagtggctcacgcctataatcccagcactttgggaagctgaggcaggtgggtcacataaggttaggagttcgacaccagcctggccaacatggtgaaaccctgtctctactaaaaataaaaaaactggccgggcatggtggcaggtgcctgtaatcccagctactcaggaggctgaggcaggagaatcgcttgaacccaggagggggacagaggttgcagtgagccgagatcacaccattgcactccagcctgggcgacaagagcaaaactctgtctcaaaaaaaaaaaaaagtcattctcatgtaaaaattcttgtaaaataatctgtaaagtcatcctcttatctgttctagttcttcataagacttatataacatgtcatatgggcatggaaaggcctaagccttcccaaaccttgctcttttggggatgattttccaaatgtacttgttctcagttgaaaagagcattgcggccgggcgcggtggctcaacgcctgtaatcccagcactttgggaggctgaggtgggcagatcacgaggtcaggagatcgagaccatcctggctaacatggtgacaccccgtatctacttaaaatacaaaaaattagccgggcgtggtggcgggcgcctgtagtcccagctacttgggaggctgaggcaggagaatggcgtgaacccgggaggtggagcttgcagtgagccgagatcgcgccactgcactccagcctgggcaacagagcaagactccgtctcaaaaaaaaagaagaagaaaagaacattgcatcatggcacaaggacacaaaaaataccctggacctgcttcagtgagatggtctaagggtctctagcatcttctgaactgaactgaatgctttgggaagaattaatagatacacgatgtatattagttcgtttcacactgctataaagaacttccctgagactggggtaatttatttaaagaaaaagaggtttagttgactcacagttctgtgtggctggggaggcctcaggaaacttataatcatggtggaaagcaaaggggaaggaagcaccttcacaaggcagcaggagagagagagaaagagtgaatgggaagagccccttataaaaccatcaaatctcatgagaactcactcactatcacatgggaaaacagcatgggggaagccacccccatgatccaatcacctcccaccaggttcccccggattacagttctagatgagatttgggtgaggacacaaagccaaaccatatcacaatggaaagctcatgaatgggttctaagaatgaggaaatgtaccttagcattttgcctacttttcctttatgacatttttttcccggcaaatatgccaaatattacctacctttacatcagtgtccacatgcatatcccctgtcttcctccttttcctcatacattaacaaaagagtaactttgttttctccccatcactgttcaccctattgtataagagaagaaaagcaaaataggatgaaagaactatctaggcacacacacaaaagtcacactctccagaagaaagaatttgctctacttggtagtagacagaaattaactcactgaagatcaccagagaatcagatccaattatatcagcaggactttagtttacatcatggtactagaaccttctttaacattcaaaacttatgaatacctagaaatagttttaaggttaatatctctatgctgtgggctaaagagtacccacaaatgaatacagttgtgtctgatgagtgtctgtgattattttggaaattgtcctgctatttaaaatgaaaaaaatagaaatgtcttagattttcctatcattaacctattgtaaacaattacatcagtgtagggttgttttgtggttgcgtgggagtattttgaggtttttagggggtaaagtgggggatagaatgaagttgttgtttgcatttacaaccctaataattaaaacaagccagagggaattacctacatggctgttgtgatttctagtgtatgatcaaaaataattatggcactttgccatatgttcttgctttcttcttagatatgtgttattgggaaaagatgagacttgacatcaactaattgcttttttctaatatacaaccttgaaccacagtgattctctggaggacaaaaaatagcttagtgacaaagagattccagaaataagagcttttcgagcttttaactctctatgtaatatagacaaattgcacagattaatataaccaaatatgtattggtccatgggaagagagttacctatttgaagaataggagtgtattgtgttcatttagaaccattcagaaacatcaatgatattagttctgagttgactaaggataaatttttaaaagcaatacctaattggaaaattattcagttgttgaccattcctatcagtgctctgaaactaaatatctcacagatgccttaatgagttattataattatgttgctgtgatacatgtagcccaagtcagaagtcacttgctttgtatttaatggatggggaagacactggagcttggagggaagagaataaaaataacctagtttcaggaagatctatgctctaaccctgcttctgccacataacaacaactctatgatttgtataagttactttacctctcaaactcgtggtttcctcgataggggataaagaaggcctatttcatagagttggtgtaaaggatttataagggctgtaagtattagttcctgccctgtttcatccccctaccctacccccacccctcatcatggctctgcaaaaacaaatatgtctcagagttggaaagacccatctggtctttctcagataagggtagttttcttcaaacagactgattcctgcacataaaatataatataaaaaaccaaaagtaccttcaacattgtagacttttcatatgtggttgtctctgtgacttaaatgtacaatctagggtttgcatgttaaggtctttcaagattactgttggcactgatctgaaagatgtctcatgcaggaaatgctcacccaattatgagcactgaggctgtatagcaatatcagaaataatattgcagcacagtattttctatggattttagatgcagtattaaaaaaagaaaactcagcctgtctttaagactcgttttctctttcaacaccagaattaaaaggcatgccattcttttttaaagtttatgtgcagagccaaatgaatatcaacattagttctccactgggtccacggcttctttttaaaaatatctgaagcagtgttactctacccactttttctcaggaaattgtgtcctttagaactggcacccatatagtttaggaatgcttgatagggtatattttaggtgggagtcacctgtgcctatatggagctttgatgtcaatgcccttgtcatttggtgtcaatggttttgtcattctaatttatttggccccaaggtgtgtgtgtgtgtgtgtgtgtgtgtgtgtgtgtgtgtgtgtgtgtttgaaacacagcatatgtatttttttcttactccttgagaaatagaactttaaataacatttctatctttaaaatgtacttgtgaatagttatcactttcctgaattctaccttccaaaggtaggacaagagaaggatggaattaaatcacacatgcagctatttttataacttatgagcactcaatgatggtagcatccctcttctttaccttctctctgattctgaagccactgctgttttggttcctgtatggctgggactgcctgtccactagacttcctgccttcactctgaccctgctacatttaccctgaacaccatcctcccaataatcattaccagatgctattttcacaatgttacacctttacacaagaagctacagtggaatattatccttacagaatcagataaaaatctccaggcggcattctaagctctcattggctacactgtaccctttgaacctgaacttcctgagaactacctcttagctcctgcctgtagctctggctcccatcttcatgcagtaggtattcgttttcttttgaacggcctcatatcttctctgctagcaggattggagtcatggcagaaagtgagagggggactagaaggatgcaacattaatgaaacctcacaataggttaggcattgggttaggtacttggttgatctactcacatcatctcatctaatctttgccaaaaccttaaaaggtaggtattatcggccctacttatagacatacaataggtacttaatgcacatttttgtgatgaataaatattcgggaatttttgcattgtgactggatgagaagaaactaggaaaaacaagacgtagatgagaaagatacctctcatcttacttccaacctaggagatcttaaatgaactcatcagttttaaaaggtaatcttaagaatggagtcagagggtcacacaaggagagaaagcatcacgtattaccagagttcgggattgcttaaggcggtttgacagtttcctccgggggtaatccaccctaggccaggcatttttaaagattagattttgaaatgaagctttgcacttgggaatatactgaggcaagaaagcatatcccttctccctgctgagagagcatatcccttctctctgctgttgcagtgcttaagtgtgagaattttcgaatgagatatgaaagcaaagacaacaaaccctgcaggataatagtctctgaggactttaataacagccgtttttaaagcaaagcctgtggactcctaaatccatagctgctcgtttaagatgcaacgcaatgcagtggacctgaaaacatactccttatctacctagagcaaccaggctccaagccaaacagcagtcctcaaattaactcttgtttctcttgggacgacaactctgctgcttttaaaggtgttgcgtggccacatatagaataagaagggaaaaaacagtcacaccctcttgtgagtctgtatccaactgcattttctgatctggttaggaacctccggtggttagattagaatcctgataaggccaagactgtgggtccaatttcttcctatggattcttctcgaaaaacttgttaggaaagatccacttcgggtttttttttttttttttttgcgcttgttttaattcccaatccataatagactgatacttttgtaacatgcaataaaaatgaattattttaaaaattacaaataccagacatacaaaatttaagccgatgctttttatttttagattgctgtacacgtttctaaagatttgctttcaatttctgttcttatgtcttcataatagaatatctgtttctgtgtgtgtatacgtatgagtgtatgcaagtgtgctccaaaagctctactatttagagctcatgtttaatgagtcatgttggataaccagtctaagggagttctactttcatataattgtttttgttttatttttatttaaatcattaacaccttttcaaaacaactgtatcaaataacagtcatttggtcatttgaagcatttacatacactgctttcttcttaaacagattttactgaatgtaaatctgctttccctggctaattcagcatcatcatcctgagcattaactattttgcttcgctataaaacgaggtgatgccttcaagggctactgatgcatggagagctgttagtttccacactgtgtgaccctggtcaattatgcatgcccatggctccttttacacctttctgattctctgtaaggtgtcacttcttcctactctcaatttagccacttaggataatttctttactattttgaattgtatgttcctgaccttctaagttcttagaaatcagaccactttttttcccatcaagctaatttaaattagataaaaattatcagtaaggaggaactaatggccttataattattcatatactaactgctttcagaaaagcttagagataatctgtctataataaaattcttaaggagatttggtcacttattgttattctttctacaccattgtgtttgtttccttacttctcagctatattaaaatggggaagttttcatttgctgagtcctattttagagaccaataattccatttacataggaaaggaaatatgtggatacgattattcatgatgttctagaatagtatcacaaccatctgcttaatggttaataaaatggttaataataaaaagaagggtacagcactaattcttgacatctcccttctttatttttcttctagtaaaacatccataacttttcctattcttccccagttgtattattacttatgaacaccatggatcattctactttttgaatgaaatagtacaaatttaatattcgataatcttgtctttgtacttttctttctaaacttttattctcggtggcttcctaaaggaagactttattctacttggtttaagcagttggtctgcattctacctatttctctcaactctcattgtccattccaatcaggttgtgcaattcattgtccctgctcataaaccaaattcatttcacctttactccattcccatgctattctttttacctggaatattttcttttgttccaatttcccaatcgtatacatccctcaaggctcaagccaagtcctgtaacttcatgaaatctatttctaacatctgatttccacatggattatcttgtaatagtaagccctgcatttgctattatttattaaagatctcttgtgttctagacgctattcaaagtattttacaaaaattccatgtaatattcaaaaaattcagcaggtatgtattattatttcatgtttagtgaaaccaaagtaatgaaagagttttcatcattatgtggctaataagggaaagagaagagaagggtcaaacctatgtctatttaactgcactttgccatgagttttctctggaagctgagaaaggagattcacaacaagagtagatgagactcagataagaaggaagtgtggaatttgaaaaagcccttcagaaaacaggatctcccctactcctaaaactgctatactgtgaacatattgcttgtctcataactgaacttttttggtactctcagctgaaatttgctctataattgtacagaactttaggccaaatgtttcttttatggggacacacattatttgtttcgtttgcacccattttctcaattactttgtgttttctcttgttgtattggatgcatctctatccactgctacaaatctgtttaatagtctttatattaataagaccatgaaattgctctttgtgtgctgacatagttatcctttattttctaatggcagtgctagatttgctaaaatttaggtagtagcattattaataggaaaaactaccaccaacaactaaacttgaaaggtaatatagcctagtggctaagagcacaatccctgaagtctgactgacgaggttctaaatcttgctgcatttattagctgtgtgaacctgggcatttttagttaaccttacagtagtttcattatcttatatggaaaatgaagataatagtagcccctaccctagagggttgttgagaggagaaaatgagctcatgtatatacagtgctttggacagcacctgatgtacagtaaggttcatgtatgttgttgttcttgctgctgctgctgctgctatggtttttgttatgtaacaactaccttttcccctttgttcattcgttattgcttttcctaaagactacaatcacaaaaaagaagaaaaaaattagagagcatacagtgaatgcagtaatgaaggcttgaatgatcttttctagttaagtcagaagtgaaataaaactatccaaaaatttctatgaaaattatcctttgtccagattggctacccactgagaactccacttgattctccatatcaatcttttgctcttttgtgctacctgagtctgaggtgtagtctttaaatgatgagtttattggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatgcaacttacaagggatgtgaaggacctcttcaaggagaactacaaaccactgctcaaggaaataaaagaggacacaaacaaatggaagaacattccatgctcatgggtaggaagaatcaatattgtgaaaatggccatactgcccaaggtgatttacagattcaatgccatccccatcaagctaccaatgcctttcttcacagaattggaaaaaactactttaaagttcatatggaaccaaaaaagagcccacatcgccaagtcaatcctgagccaaaagaacaaagctggaggcatcacactagctgacttcaaactatactacaaggctacagtaaccaaaacaacatggtactggtaccaaaacagagatatagatcagtggaacagaacagagccctcagaaataatgccgcatatctacaactatctgatctttaacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatgtacaagaaaaaaacaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcatttaaaagtcaggaaacaacaggtgctggagaggatgtggagaaataggaacacttctacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaaaggatgagttcacatcctttgtagggacatggatgaaattggaaatcattattctcagtaaactatcacaagaacagaacaccaaacaccgcatattctcactcataggtgggaattgaacaatgagaacacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctgcacgttgtgcacatgtaccctaaaatttaaagtataataataataataaataaataaataaataaataaaaaatgatgagtttagacaaatatcattatggtagtattatattatgttatgttatattatattatattatattatgtataatgtatattccttgcagcctgccctgcattcccaatctatgactcatgctgccttattgatactgaaaaatctccactacagcatgccagcttttgaaagagagccttgggttctttcccaatacttaccttccttttagggcaacctatctgagtcctgtagcttgaaagatttcctaccagcctgccatcccaaaggaacatggatgaactatgtttatgctgatgtgtcaagtcatttcttggtatggttcatagtagtccacatggctcttgtagacaaagagatgaattactgatggcagaatttctgttctggcaacagggaaatttgcagaaaggagaccttttcagtgtgaacattttttgctcacaggtggtccaggatgcccaatgctaaatgagaagtgaaaagagcaatcagggccaggtgtggtggctcacgcctgtaatccaagcactttgggaggccaaggtgggcggatcacgaggtcaggagatcgagaccatcctggctaacatggtgaaaccctgtttctactaaaaatacaaaaaaaattagccaggcgtggtggcgggcgcctatagtcccagctacttgggaggctgaggcaggagaatggcgtgaacctgggaggcggagcttgcagtgagccaagatcgcgccactgtgctccagcctgggtgacagagcgagactctgtctcaaaaaaaaaaaaaaaaaaagagcagtcagaattcaatttttcattcagaacaaatcaatccacgtgggtaaacattttatcaaactcaagaatgctgtctttcagggtgcttttccctcaacagtcacttatttcctcttgcaagtagtatcttcgttcaggttcagtgactactgtgtattatatccaatgcttctggcaagtgggttggtggaggcagcccaagatcttctagaatcaagagaattggatccatttcccagttctaacacttatcagctatatggcttttaggcaagtcagttaaacatccgagtctcagtgctctcatctgcaaaacagaaaatgtgatgtacttcacagagccagggggaggaataactaaggtggtacatttgtacgtgctttgtaacctgtaaagccctttactgtacacgtgtcatttacagctctgtatcaccatcatgacctagaaaagcagtactgacagaagacttatcttcttgccaatgctaagataactttagccatttctgcatttctaaaggaaggagtctttatcccagtatctatgaagacttggcaggaattgccgtcaatatttagttggtaatataaacgaattaaacaaaaatgcacactaggttttaggaaaattaaagacagaactatcatttgtactcctcttacatttcccaaagtgctaaaactagacaataaatcagtcctcaataaatgcttgtttatcaattttatattcatttatttgttgataatacaacaaagatgtttatatgcagtataatatatatggcaaagatgaaaagtagcaaattcatgaatcaacatcctatttatgcttgagaagacaaagaaagtgttggtgacttcatggtatacataaccttaaggagctcgtgattgagcctgggtctctgctatcaatgtaggatataaatttcaaatgtactatcctttatatgtatgttaatgtagtaaacatagaaaactgatgctactagtgagaatacttttacttgaacaactaaaagtttgtctttaatcccctaagtgcatacacaaaaggaaagtactgtacaaatcaagtacaacagaagaagtaaagtaaaagacaagtgaaggaattatctggaacttagatctggttggctttttctcctgaagtacttagataaattaactcacttttctcttttgctgaagaagtgcaaattaggcaggcatgttattccacgtaggcaaaaggaaaaaagaaagaaaaacataaaatggctatatatttgaccaaacttcgttctgcaagaatcccaatactaaccttctaccatataaactactttcaaaatcaggctatatccttccagtacaaacctggtttgtactactcagagatactactcagaaatactttcagtatttcccttctttcaacttctgatgtgattctatccatattcccctgcctgtctcccagtcaaagagaatgggacacaactctctttagagtccatcagtgatgctttagctgccaaaaatagtgacaatagacattcattgtctgtctaccttacttgttcaacattcagaattctgcatcttaagaggctgtggctgaaaacttgagccagttcttcagaatttctaacatgttatttctgccactttttctcccttactttagcagagtaatttaattcaatttgagagagagagagaaaaaaaaaacttttctagttacacagatcaatccaattgtttggagcttcagaatgaatttttaaacttgttgaacagaagcatacaaatctctaagagcaagtcagataatatacaaagcctccattcattgtgtaggcagaaaggaatgctggtacccggcagctctctgaggaatgttcccttggctttgactattctgctgggaacaaggaaggaaacacatatataaaatgaatttataatgtctctggcttgtaatggcagaatgataagaaaagttggctgtttaatataaactgtcagttgcatattccaggcctcctctctttgaggttcctcccacatccacacgcctggctactgtttagtgcggagtacaaagtggccgtttattattattgactggtgaggcctgtgctccaaaattcattctgtcaacagaatgtaagcaaagttggcattttaaagcagggctctttcagtttctgggttttctcaggattgctatgcaacaggatcagtgctgtagtgcccggttcaagctgaaaatgttacacaggaagacataccatgtaaaggtcagattcttctactataataattttcttgatctgtgtgtatacaagtgaagttgaatgcataacctcttatcataactcttaccaaggtcctatgtactttccacctgtcaagcctaaaaatgtgtattaaatgggaaatcaaaactaataaatgtatgatgctgtactatatgtatgatgctataataccaaggtgaacttaatttgtgttgtcaagaagattttctctcccatgacagactcccaggaatgtgctggtgctgtgggccaagtgcaatcttgtttattagtctctccacgcttttatggtcagagttaactctacagattactacgtaaatagaaaatatgacttgatccatatagtaatgaaattattggcactggggtacactttatcatagaattttattgcctatcacttccataaaataatacattttgtccatagactagaagatataacttgtgaactttataaagttataaatacattactttccaactcataatggcaaggaataaatctattacaactaataagatgcccattttaaatctacataataacaggagaaggcaatacgccaagaaaagggatttgagatgtatcttcttgttagtttagcctgattgaaatgtcttttgaactaataattatttatattttgcaattctccaaattcacattcatcgcttgtttcttttgtttggtaattctgcacatattcttcttcctgctgtcctgtaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtaggaaaagatgtggagcaaaaaggccacaaatgaattaaaatggccaaattttcctcattgtcttagcacaagtaactggtatctcacatgtctacgtaaatcatccaatttcagaatgattcactgtattttgaataaatgaatcatttatttgcttggtatggagatgatacttgaggattcagattagattaaagtggtaatgttttataaacataggagacatgcatattaagacatcagagtgaatttaaatgaggagtgcagctattctagtttcataaatttctctcttggcatatcacagggttatacaaaaagtgataaaaaattaacggatatgtattatggaattatttttggcattagtctaaatgcataccagaggacagtctttaaaaccctttataacacattacaattatataatataaaacctgtaacacattataattaacagtttagaggagatagctcctacagttaaagagagactatagcaacttcctgtcttttgcttcctctcagattttgttaaaacacatcctctgtaaactaagcttttagttgtagtatactcacatactttatattttgcccccttctatgtgccagctttctttggagaagttagttaatggatgcatcatagcatctttgtaaaaagggcagagggaagttcttgttataccagttttgcaatagttccgtggaggaacaaaaggatagagatagtaagtaaaacgcccattgtaacttaaatgatctagcaagggcggggaatgaaagccaggcttcctgctttctaagcagttgcctttcttaattcatttctctttattaaaaatattttgtgctttcttctgtgtctagagaaaaagtgataatgaagggaggtagaagatgaccaaatggacttaataatagttatgggagtatacactaaatgacgggagtagttactacctctaggtagaaagattacagaagggagattttttttcttctttatagttcttctaacttgtccaaaattttaacatatatacttctataaggaggaaaatctgcatttttagtaattcagaagcactattgtaaatgtctgcatcaagtatgaaataatgatagcaactaatatttacatgatgtacctacataccacgcaatgccataagcactttccattcattgaccggtttaatgctctcagcaaccctaagaggtagattttattattgaattctttttacatttgaagaaagtgaggcacagagaggctaaataatttccttagggtcacttagcaagtggaagatacaagatgaaaacagggagtctgggtgggccaggcgtagtggctcacgcctgtaatcccagcactttgggaggccgaggcaggtggatcacgaggtcaagagatcgagaccatcctggccaacatggtgaaatcccgtctctaccaaaaatacaaaaattagctgggcatggtggcacgcgcctgtagtcccagctactcaggaggctgaggcaggagaatcgcttgaacccgggaggtggaggttgcagtgagccgagatcgcaccacttcactccagcctaggggacagagtgagactctgtctcaaaagaaaaaagaaaaaagtaaaagaaaaagaaatcagggagtctgacttcagagtctgaacttttaaccaccatatgataccgtagcatataaagaaagaaggaaacttctacaaagaaatgcatactaattgaaaggatgaaatagagagtagattttttctaggagtagaaaaggatttgtttttatgagaagtagattgctaggagtagaacaggtttatttttatgtataaggttttgttttgttttgtttttcacaagtttgcaccctggcttcccagacattgttccttatctccctattttgtatatgaattttgtgtcaacttggtggtggtacactgggagcaacaatggcaatagcattttcaaagatagggaggctctattagctttctacagcttaaactcttaagagaggtcagtatgtgtgatgacgtaggccactttgataaccttcgtcattaaaaaagaatgaaaatgtgagatggaaaaaatattggcaggtcaagttaagttattcttttctgcacaaaagaaaaagaaagatgctataattgttccgagtatcacttagtgccttttctctgcctcatgtgaacttgataaaataaaaggagaattgaaagtggcaaatagcatgtcagccaaaatatggactcttcattctcagcagtttcccatgtcagctaccgcagtttgattcttgctgtcattaatcaggtagaaaacagttagcttatctaaggtgctgccaattctagaatttaaatattcagatcaatggttttggcttttatataggcctatgtaataatacaggatatgttataagcactcataaaaagcaaagaagtaattctccacatcaaagcaatttagcttatttcctgacacttgattgaaattagggtattgatcaatctacagcaaatggcagggttcaattgagagaagtacagtataggcagtaattagggatgattatgaaatagaatagaataacactggaagagttagatatagaaccattagtggcactgataaacctgcattatgaatcttgtcacttcttccatgggggttattttaaaatgaaaagttgccacaattaaaaaatagtttcaatgatatactggaaaaataggcctgtgtttgcccaagttataacatattataaaaaattacagttggcccattgtttggtgagcgattctgaaactgctcttatatttcaaaaaaataaaaccattaatgtgtccatttttaaagaaacaaaattgaatttaaatccaaatgatttcgaagtttccctttgtattccattggctcataagagatatccttgtgcttccaaatacaagtccatattgtatcgttttccttccatttatttttcttctgccatacatcttttctcttcctgtgattaagattcttatttaagtcatcatgttatgccatattgatacatttgcaagaatactctaccttggacgctgtttatatcatattactcttttgttcaaagcttcaatcttgtaggtctccatatctccctcattcatttatttgttcattcaacaaatatttaatgaatgcctactatgtactaggcactcttctgggcacggaggatgcaaccatgaataaaacataccaaaaaaaatcactgctctaatgaagttatatttaatcattagaatctagtagaaccttctctctctgccaactgtgcctaataagtccttgctaactccttcccttctcttttctttttctgcctccagttcctttctcaccaagcatcattctgttactccccaacatagattctctgagccaagagaatcaataaattctattttctaaccccattcctactctccaacaatttcctcactctcccatatgagtatgtacccttgctggttctcacacttgcaacattctctttcctcttattctccaaattttgattcatattccataacaaatcttttcttttctggctgtttcctcactaggtcttcccaatactattctaatttacacttgataacatgtttcttcaagtgttcaagagttgctttatagggctatgcttactgcctccagctaacttatatgaatacaaaaatttcaaactcgaaatatgtgagtatggtagagtagaaagacatgggccagcagctgggcaacccagtttcccttctgttctattctgtcactaactgtcttagcatataatcttgatcaagtcacttaactgcttcagacttcaattttctccttcactgaaatgaagagtttgaccagaaatatggacagtctcttccagttctcttgcaatcgtacaattttattcttttagttctgcaatcacactttatgaacctggaaaattgtttaatttttctaccttggttttcttaattaaaatagaactgattgatttaaaaggcattatataaagtaattaagatgtctttgagagaaaagaaatttaattgaaattgtataatcctatctcataatttaattcaagaaaagtatatgctatcattccacatgcattattacatcacatgttggccaagaggtataaggaagaaaagtaagtagtcagtgataatttaagttccatcaaacaaaacgaaaacattaactgctttaagtgggagaaaaagagaaaattatttacttaaatgtacacacacatgcatacacacacagttactgatgacgttatccaatattaagatggtaattagtcaaagaaagtgtttttcattctaaaattccatatccacaatccttgcatttttaattttagaatattaataacttgagaagtggtcaagtcaattgttttacataagaaatatatatgaagatttcaatttagtctactactagattatttttccagatcattgtatatactattaactatgaaaatcacataatatgttatcaacataatttcagcagaatttacattatgtgagatttttatatttggcagaaaaatttgtaaatgttatataaaatgttcacatttatacaattgtgaacattaagaggcaaggacactgacattatatagtctgtagaagccataaatctattggggagtgcttgctattagaggttagaatagttagtgtctttgtataatggagaacaaaagaagggcaaaaagaggtggggtctacctttgagagaaaactgcaacttggacattgaatatctctgaccttctttctctctcttttagaatgttaattatgtttggatgttggagttcaagacctgtctagaaaaaaaaaatgttgacttctctttgggattctctctatttaaagagatagctcccattttaattctgtggttctttaattttttttgtttctgaagtacaaattcaaattattcatctgttgatgacaccctggagatttttctcagtgttctcttgtagtagtttcatggtttgaggtcttacatttaagtctttaatctactttgatttgatttttgtatatggtgagagataggggtctagattcattctgcatatggatatccagtttttccgcaccatttgttgaagagactgtcttttccccactgtatgttcttggcacctttgtcaaaaatgagttaactgtaggtgtgtggattcgtttttgggttctctagtcttttccatgggtctttgtgtctgtttttatggcagtattgtggttctttattatttctgcattcctcccttttctttctgcatgtttaagtgctattttattacatgagggtactaaagatttatagggatatatcattagttttataaaggaagtcaaagtgaaaaatgaattcaatataacacatttcactttaagaatgcatgcctttcagagtaaagttttattaaggatttcaaactaggcattaaccaaatcacagttgaaatatctgtgtctagagaaataacaatcactttatcagcccctataattcttagtgtcctgacactgaggagttccttaaagaccaagcaatatactccagcacatctaaaggctctgcgttttacctaaaccttacaaattgtggaaattatcagctttttagagattagcacttgccttgttaaacggtagtaacccctaagctcttgtcttcactaataaagattaatagacatagatagaagctaagcatgcccctttgaaccacctcttttattttccgttgagtgggtaggagtaagcagaatatatttgacaattagcaatgttaaaagacaaactttagacaaattccgttttgcagagtttatttgagcaaaaaacaattcatgaatcagacagtactcagaattagaagttcagaaagctccacccagcaaggtgggcaggcagtatttatagatagaaaaaggaagtgacatacagaaacagcttgactggttacagcttagaatttgccttacttgggcatagtgtaaataggcatttgccttatatggacatgagctgatcagtttacagcctgtgattagctgaaacttgactgctgggattggctgaggctcagctatttgttacaagaatgtactcttaagttgcatattgcttacatgccaagctgggttgcagtttgctatgtacagagtcagctttaggcccaatttaatttaatttaacagcaacaagcctttttgttcagagatcaaaaacatttggttaaaaccactaaggtttaaggattttctcatctaacaaaggtttgtaatttctatttcccatatctaaataggacagctcaagttatgtttttcagcagctgttttatacctttgcaatcttgatttctacatatgcaaaacaagaaggttgaactataatctctcaggttccttccaaccccaacagcctatgtatgatataaccagaaaaaaaagtcattacaaatacaaagaaacattttcaggaggagatattccacatgcaaacataggttaatcatttcaaaatatctggtatatacactcatgaaaataaaaatagggcaactgcttccgataaatgtattagaaatgtgacttgaaaacatttcacgggcttaacatggtcaaagaaaatgttttgagctcacaatgttccttacatttagatcttcaaaatcaagtcactgacaaatgccacctttgccctgtggagaccaagaagtaatgtttggggcatatcagaaatgctttaataaatgctttatcaaagaatggttctggagcttacctgtggaattgtgaaggttcttgttgaaagcagagattgttgatagaattatagaaagtctggaggtggcacctagcaatctcaattttaaacaagctactcaaatgtttcttatacacactatagtttgagacccagagctttaggttgaatacatttgtatatgctgttttaattcattctctggctgcctttcacctcttcagttcttactcagtgttctctgtcctttgtaagtttttcgcttcagtttttgtcctcctatcacatttttcctttcactcttgagctttaggagaggaaaaaaatgaagcaatttgatatgtagttaggatgatcaaacattctgaaattttatctaactccacagcttagaaaaaaattaaaggaagtccccttacccagatatgtgagagcttttcgtcttttgaggttccaggtccgtcttctgctgctgtattagctctcttgactgtcctctgtccctggcttctaacaacttccctatttcatgctattaagtttctcttagatcctttagaactgaattcccggctgggtgtggtagcttacgcctctactcccaacactttgggaggctgaggcaggtggatcacctgaggtcaagagttcaagaccagcctggccagcatggcgaaaccccatctctactaaaaataccaaaaattagctgggtgtggtggtgggcgcctgtaatcccagccacttgggaggctgatgcaggagaattgcttgaacccgggaggtggaggtgcagtgagccaagatcgtgccattgcactccagcctgggtgatagatcaagactctgtctcaccaaaaaaaaaaaaaaaaaagaactgaattccctaggtctcagttattttgctctctcttaggggacctaaaggggttcattgacccactaataatgagtcagcaccatttaacctagaactggaattttagcacttccttacataaacaaagccgcagcttgaggtcttaacataggcagcctgcccttcactatatcctcctctagacctctctgccacaaggatattttgtttcctctaccaggcagacagaggccaaacattagtcatcgttatattctctcttcccttcctctctccctactccccaatgtatcctagagacttaggggcagtcaataaatatttatttaatcagtgtcttttctaccatttgctgcttttccatgtctgagccctacctctctccacctacttttcaatatgtcctgcttgacagcctcttttcactctcaaagggaccaagctgtgaattccagacaccccaaggaattcgtttaaccattacacattacatgctattaaacagctaaaatcttgcatggggaattgtcgcttaggcttatcatggaaaagtggtaactgaaaggatggtacagaaacataaaagaactgacctctaattgtatgcaatctgcatgcactattatattcaattcatgacatttatggtatttcacgattcagttcttgggaaataatacccttagagtctggaacaatttaatttatcttatttgatggaaatgccttcatttttcctggacatattgtttatactgcaattatagaaagaaaatcttgacaatttggaaaagtagaaagattaagaaataaatcacctgtaaatctacctctgagggataacctggttgtcattacaaaattttttcctagtcaagcatgtgcatacaaatacatacacatacacaaatgttttagaaaaattcaaaaaatgtatttgttttgtaacctgttttctcatttagtaactgggatgatgaccttttccatatccataaatatttggctatgtcatcatattgaaccttgcaaaggattttactgtatgaatgcaccattatatatgtaataattcccttttaaattaagagctatttaattaaattcatatataaatttcattaatttctaaatttaaagcatatacaagtttcattacatttgaaaacaatcagtaggttggggttttgcatttctcaagcaattccctcatattgaatatttaagttgtttctgttttgttttatcaatcataaatgatgctatatataacatttttccacctatatctttgtatctttttccaatttctttgttagtataatttccttgaatttaagcctgtgggtcattgtctttgcacattttaaagacttttatgtattgtcaaattatccttcagaaagtttggaacaatttaatttcagtagataagtattctttggtgattctgtttgactaaggccaaaaggagaattgtatttgtaatgtcaagctaagttaccaaatggctaagggaaatgttgctccacctggttgctttgctttacatttcaatctttgcagcgttaaagtctttattatatttatgttataggtagcgttattatgaattaattagtaattgctgataatagctgagtgattgagcataatttctaatttacctgaagataaagctttgctaacactgcgtttcctctttgttttctggatgatgatttattttattaatttagcttctcatcttcaagtgaaatgtggattttatagcacagatcattcatttgtgtattcttaaatggcttctaaggattaacgtgttctaaatacagttgacggtaaagcactcagtctcctgcctaaattattcatgttcgggggaagctttcagataaatgtctgattttactcttccatgtgagttgttgtcttagtactttttacacaaaggaaacaaagcagaaaatgttgaaacttggtgaagacaaatcccaggtgcacacaaataaagaagggtagggggaaaggagacgcatttgggaagaggagcagaaaggaacagacgccagatggaagaactcaatggaaaaggctgcctagggtgtagaaatggaaaagtcaaaatgtggggagagacctttccatttctcaaggcaaaaagaattccagtactagcatgagtcacatgaaaacgaagtgtttttcattagtcactgcatccaattttttctaccagaaatattaagaattgttgactacaacagtatggaaaagcaatagattccagtgtgtatttcatgccaaaagtctcagcattctgcatgtggaaataaacatatggctaaacactgccttttctcaaaattgccatcaaactatcctctgttttgtggctctcaaaagtaagtagccagatttttattcaagactgctttgtagttcacaataggtttattgtactttttcaatggaattgttagaatcatcaattacacttctagatattctgacatggtacgctgctgttctttttcaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggtaggacatttttaagcctcgtgccttgcacatgttaagcacatagtaatccagtgactattttaaaattaattttgtttgaaattaagttgaatagaaatcttttttactcttctcacccaagggtcaattataaataatctaagccattacactgtaaatgtcaaacacatttgtgttaataataccctttaagaaatcgtccatctcttttggctatataaaaaaaagcttttcatgatgaaaaatattgaacatatacaaaagtagacagaatgctataataaaactcgtactcatcaagacatcaacaattatcaaatcacgtcagatcttatttattctatagctcttcccagattgttttaaaacaaatatcaggcgtgtgttattttattgttaatatttcaaaaggttaaaagataggattcactcttttaaggtaatcaccttgctactataatgcttttgaaatatcaataatttcatcatatcaaatatccagtccatattcaaatttccatttttctcatacatattatgcattttttaaactttttctggttttggtttaaataaaaattgaaatcagacccacaccttactttggttagttggtctttttattactttttgtttggaagtaattacagattcacagtaagtttctaaaatagaatagtttccctgtatctttcaccctgtttcttttcatcattatatgtcatgcaactgtagtacaattcttattgtcatttcaacatgcaatcaatagaaaaaatgtacatttacagcacatctcaattcaggctcattacattccaagtactcagtagccagatgttgccagtagctaccgattgaacagtgcagttctatagtttgattgtatttgggtttggctttttttggcaagactgcttcacaggtgttcgtgtattcttccatcatcaggaggtggtatataatgccttgttttctctttttgtgtgatgtttaatagctgttcacgatcagtggctaggggttgcagtgtgataattgcctatctctaccattccttcttcatttattcactggggtaggtctatgaaaaaaatgttttgcacttgtctcctattttggtactcagtatacctttcataccgaacaagcaaaatacgtttcaattttaccaatttttataataacaacttgttcactagcatcctccaacgatgaccaattatttctttgtttgtttgttttatttttatttacatttctatcttctctactaagctctgagtgaaaaaggcagagattttgtcttgttcacctccaagaccctagagtctagtaaagtgtctggtgtagagtggatactgataagtgttttggaaatgagaataaaagatacaagaacagaaatgaatagcaaaccaaacaaattactaccaaataataaaaacttgataaaatggtaccacttttgtatgttgagcatgtaaaggaaagatctctgtggagatacagccaaaggtggcatcttgaggaaaggtcaagggtttatattattctggagaagaggatataggaaattataaaaagggaagagaacatgaaagaagacccagggatctttgcaaaaaaaaaaaaaaatgccagggaaactgccagtttctcctttagccatttgccttcatatatttctgaatattaaattagcttttgtggtagggtgaaatgtaatggtgctatgtgttttaaatgttctgactttgaataaacagccaaaacactctggtgtacatatagaaaagcactcattgagaaggatgggccttttttaaaaaatgcattatgcgatatagtgaaatgagacagaatttctacaaaagatgaattttatgctagttccagaaaccaaagaaaatgaatcactggacatgtgcactaggagtcaggagactgagattctagtcatatttcttcataagatggattctgattgctattttgttcttcaactgtaatatgaggaaattggtccaaataattgctgtggtttcttccagccagtattttgttataaatactgcttcactattcctggttattagttttggttgcttgttaagagtggtaaaatgtctgtacttaacgcagtccttactcaggaatctcatgacaaagaacatgacttggggagatggtgatgctagagttatgagtgatactcaccagaatgaagttaatccgtccccacttggttagtgtgcttgctcagatagctacctgttaacctttcgtgaatttcacaggacttccagcccattgattactctgtgttttatacattagttcctctgcccttccatatttacctccttccaaatacaacttagattcaatcatctaaattttaataacttgttttcaaaagtctgaaaccctttgcttctttatctttttgttgctgcaatctacaaaactccaaaactctagctaaatattccgagactctaactaaatattttctcataccagacaacaatgtagttgtctggtacagtaccttttccggatgaccagccttcagccttccactaccaagacatcactgggtcaatttttttttttttttttttttgagactgggtcttgctctgtcaccaggctggagttgcaatggcacaatcttggctcactgcaacctccgcctcctggttcaagcaattctcccgcctcagcctcccgagtagctgggactacaggcacgcgccaccatgcccacctaatgtttgtatttttagtagagacagggtttcaccgtgttggccagatggtctcgatctcttgacctcgtgatctgcctgtcttggcctcccaaagtgctgggattacaggcgtgagccaccgcacctggccaatttaccttcaaaattgtttttgactgtctactattgttatcatcataattatagaagaccatttctcctaacctttctgcatctactcttgccaccctacaatgcaatctctacatttcagtcagaataatctgtgtaaaaaacataaatccaattatatcagtccttatcttaacactatagtagtcttctcagtgctcttggaaaaagaccaaaatcctcaacaagggtgacaaggcactatctggcttgtctggcctcagcctcctctttcctagatgctcttcccttgctgtttggatgccagccatactgcctccatttactttttccaattctgcgtgtccctcttatgtggggctttaaatatgttggtcctctgtctcaaacccttttacctatacccacccactcataatatcctggttatcatctaataatcctttacatcttggctcggacattgtgcaaacttttccctgttgtctacatttgaccagatctttctttacacacttctaaaattgtctacttttctataacatagcgttgtttgtcatcacgtacatgtgttactatttgataaatatcgactactcttgctaaaccatgtccttcaagaagatttttgggagggggaaagctgtcatttttctactcagcacattccaaagtgcctagtatacagtagacactggttagataaaggaaggctattgagaccaagagcagggaaagaaagaatagagtggtattcccttcttatttacaggagttttctgtttatttctaattaagcatctttttgtaaagtgtgtagagctactttgatgcacaggtttttttttattattatactttacattctgggatacatgtgcagaaagtgcaggtttgttacataggtatacatgtgccatggtggtttgccacacccatcaacccgtcatctacattaggtatttctcctaatgctatccctcccctagccccccaccccctgacaggccccagtgtgtgatgttcccctccctgtgtccatatgttttcattgtttatctcccacttatgagtgagaccatgcagtgtttggttttcggttcctctgttagtttgctgagaatgatggtttccagcttcatccatgtccctgcaaaggacatgatctcatccttttttatggcttcacagtattccatggtgtacatgtgccacattttcttaatccagtatatcattgatgggcatttgggttggttccacgcctttgctattgtgaatggtgcttcaataaacatacgacatacagcttttacttgtagtttggcgcaatgctttttcaagcttctcttggtatctttaagaaaaattcttgacacaaaacactctccttcctcaaacaacatcatcgctcctgagtgctgatgagagaacagtttagtagcctgtttgactcaaagttttgtcacatgtatgtggtagccctttcatatatggactgtctagttagtgatgctcttgaagcctatgggcaaaagaacaatggaaaatccttgaaactggatctgcgtatcagatctcctgaactcagttagaaaaagagaaaaagaacagaatcagtacaaaattccatcaagatctaatagttgacagatcttatatttgtggacttttgttttactttgccatgtttccagaattgtacattgtattgctctttatgggtttcttgatttaattgttgtttgtatagaatccttggtatcaagatgggtcactgtaattgtaaacttattccgcaagtatttagagtgccacttttttaaaaagtcatctgcttactctctattctaaattattaatatcctttgctgatgctttttatggggatacaaatcccattaaaatgtcaatagttgaaactaaaatcaaatgttgttcattttcactttcattttctataaatcaggatgtttacaaaacaggtaatttgtgtttttctttgtataccatttcagattagtgataatattttgtagcaaaatattacatatcttgtactcttttcttgtagagaaaatatacagtcaatatcaattgctgtcatggagagatatatggttcttctgtaggtaaaattccaagatactccacagacatatttggggaccatagtctcactcctcaaagcaattttcacacccatgggagtagatctgtgctccccaaaccagctgggcagcataacaactgcaactgaatggctctcaagactaattaataaaataatgctccagatgcggtgaagtgttataaataattaaagctcaaatatgccttagcaaatataaactgaccaatttttatgtcttttgaatacattatcctggcttttacagttcctcattacttgcctcactagactgactcgttttcaattagtgggtgttattctggtccagatatattttaaaaactgacttcctttgttttacttgagcagtcactaaagtgatatttattacttgtctacttctgtgattaacctagagagagttttaaaggagcaaatcatagtggggaatttctaaggagaactgcaataaaacatcagcttattcaactcccttcctcctaccccaaatccaaatggagattagatcttgattgtaacaacagtgtaggtaatgactttttgtttgcctttttactaatgaaattgtttgtcactaggttttcatctttcaattaaaaaaatctctataatcccttccctagagatcattaaggataccttcaaagcttcccgagattttctggttaagatttagatggaagtaatcaatacatacattattaaaagagtggacagaaagccattattgcttggatgctgttgacaaatgaaaaggcttgaataaagtagtttacttgttcatttgtcaggtcatatattatgcatgttcgatttcttcagaagtcaccacaaagtgagagacaggctgagaaattcaataaaattatcctgaaatcatgttgtagattatacatttatttaggctcattctgttatcagtgctggcctgcttacgtgggatacattttagtatgtatgttagcttgacgagttttctgtgttttctttttacagaaagagaaaatatctttggatgtcatttgtgaatgttaagatttaagtcagctctgtgttaagaaaaatgcgttgttccctatcacctctgaaaaacaaccaaaagttgcgatagagtgattcattcttttttcttttctttttatttattttttctttaatttttttttgagatggagtctcgcctgcagcccaggctggagtgcagcggtgcgatctcggctcaccgcaagctccacctcctgggttcacgccattctccttctcctgcctcagctgggactacaggcacccaccaccacacctggctaatgttttgtatttttagtagagacggggtttcaccgtgttagccaggatggtctcgatctcctgacctcgtgatccacccgcctcagcctcccaaagtgctgggattacaggcgtgagccaccgcgcccggccagagtgattcattctaacattcaatgacctggcctcttagagtttctaaaccacttgactgttagttatatctactctaaggtgtctttttagccgcgttggaggaaatagacgtctttttgatctattcttcatcatttttgtataagtttgatatcctatgcagtcatatttagggatgctgaatagaaatgacttaaaaattatttttagaactgcatttctaggcatttgagtcttctgaaaactaagtctaagtcttctgaaaactagctttatcatcaaaactgaagaactgagtcatctaggaattgctgctttgctttaatgactgtaacaagatgagatgtgaataatttacaaactgacttctctaccagtcttctctctcactttgtcaaaatattttgatgtcctgacaaatactctttaaaacagtatctgcatagtgttttgccttgacaaagcacttttacacacattattcatttaattacaaatgatccccttgatttttttctgtgctcttccttttgtcccccaaaaacattattttaggaaaaattataccataactcagattcctagaatttattggttctttcaagaactttttttatgaagagcctactctatgttaagcatatgttagggaacaaaatgagtctctgcccctatggatgtttagattttagtgacagaaatacatagtaaacccataaattaatatatgaaattatgttgggtagtaagtgctatgaagagaaaataaacaaagcatgaatagagaaagattgaggagtactggcctatgtgaggaggttattttggggtaaagacttgtgtgaggccgggtgcagtggctcatgcctgtaatcccagcactttgggtggctgaaacaggcagatccctggacgtcaagagttcgaaaccagcctggccaacatagtgaaactacgtttctaccaaaaactagctgggcgtggtgacacgtgcctgtagtcccagctacccaggaggctgaggtaccagaatcgcttgaacttgggaggcggaggttgaagtgaaccaagattgtgccactgcactctagcctgggtggcagagtgagaccctgtctcaaaaaaacaaacaaacaaaacctgtgtgagtgagtaaaccatgcaaaaaccttgaatgaagaggattctaggcagaagaagcaccaaattcaaaagcccaatggtaagaacaggttttgagtgttgtagaaatagcaagatgagctgtgtatctcaagggaaataagatcagtagacagtgataggttctagaaagagggaaaggccagataatgaatggtcttgcaggccatagtttggaggtggattttattctgtgagtaaagagacatcactggaagtaaggaaacatcactggaaggctctcagcagggatgatgtgatctgatttatgtgtttagaagttgactcttgctgctatggagaattgactataaaaagagcgaaactgaagacacagaaaaggagggtggtggagtcatctcagaaggaaatgattacttggactagagtggaaatgataggtatggtgaataattatttgatcgaagatatatttggagggtagaattgatagaacttaagatagatagaatgtggagtttgagaggaagcaaagagtcaaggaaaattctgaggtcaatggcttgaacaaataaaataatgatgttgccatctgagaaagacttgggaatgatcacgtttgagtgtatgtgcttagaatgaaccagggttccatttttggattatgttgatagacagacacaaagggtatgattcagatattatttaccacttatacttgacaatctcaaattttggctcagtatcttgagaacatacacaaattaatttgtcacagggttttctaataatccattcatttctactaacatttcagaagtaatttccaaatcttaaagtttaggcttaatgacctaagacctaattccctaaatggccacgggaactagattgagttttcaccagtgatctctcaaggtcagctcagaacttaacaacattattgtcagtaggaagtaacttccccagtgattgttggaagcagcccagccttagaattaagagtcaaacagctgttcaagatgctgtgtgcgcagtaaactattcctccatagtatcacagacctgcaagcaggctggactattctagcccgtgcccttgatctcagagaatacaatctttgttttcaaagacttccagaaaaataaatctcaacacagagtttgttaaacacattttccccttatacactcaaaaatgttttttcattgactataattagatttttaaaaaaaaaacataatttcaggcctgaaatatgttcatttacttttcaattttacatcaaatttattcaatctcatttataaattaatattgttgttcatgttgttgactatctgaaacaatgaatggatgtatctgatacttcaatcccttatcttcacttttattcagaagtggagtgaaaataaggcggagctttttgtcatcttatttagatgattatttagtcaaactcatagaagcagagagtagaaaaatggttgccatacattgtaagggcgagttgttgctcaatggatataaagtttcagttatgcaagatgaaaaagttctagaggtctgctgcataacattgtgcctatagttaacaataccgatttgtgcacttaaaaatgtgttaaccgaggtccggagatcaagaccatcctggctaacacggtgaaaccccatctctactaaaaatacaaaaaaagaaaaaattagccgggcatggtagcaggcacctgtagtcccagctactcgggaggctgaggcaggagaatggcgtgaacctgggagacggagcttgcagtgagccgagatcgcgcaccactgcactccagcctgagtgacagagcgagactccgtctcaaaaaaaaaaaaaaatgtgttaacagggtaaagttcatattaagtgttcttatctcaataagaaaagatgattatggccttttctttatagcccagatacccatgttcataacttctgtaatactagctgtctcaaatgactattaagggaaacctctctttctgttgtttgctccattgcctctttcttcaaatttttttcttccatgaacccctatgaatttgctttagattactgggggcaatattcttgccaccctgccatgtacatcctggattgcttgcccttttccaagacctcgcttttaagttaactgagcattgcttgtcccgaagtgagcatttggtaaaatattcttatgtgtttgagactcaataaatatggtggctctttaaataaagaaggtccttttggtgacagaatatattcagcaactttcttgtcagacatagaaacaatacaggagacataaaaaataaggtagaaataacacaggaacaagaatgatgacgtaggatggcaaaactagtaaatacagatcaagttacagatatgactgttaacatcttgttctatgcctgctcggtatccatttgttgaatgaacagaactgttggatcatcctacatttcagagcctgtctagtgtcctctcatctcctacctaatcctgcagactacagaaaaagccccaagcagcagttcaaaccatggaacttctgagtgtttggacatgaaaatctcctttaagaaatcactaggttgaagaaggcaatgctaatgggaccacttcttgaggaaattccacccagtaactcagcagtgacactcagctttggatctggaacatgagtagacctagaataagatctgtccatttttcccaatttacagcattaattttttcacttatgattcatgagtccaggctttcccctgcaagcctgttttgcatctaaatcaacttggccttcatataacacactctagtgttctaactgggtgttctgtatcttagtcaacaatgtttactgagcatttactatatgccaagctatggctatggtttttaagcatcgataataacgatgcttagcagagactctcaaactgccaccatagagcaggcctgtggccgattaatgatcttaacaaattgattatagtatatgagaactggatgttagaacttagataaggttttagcaaatgcccacattttacaaatgaggacacagaggagcaggaagagtttatcaccttttctggatcactgcagccaggttctggcccagcccaggcttgaagcccaaggcttctgccactcagaacagtgctcttttcaccacttcagcctgcctcccaggatgattctaggaagttctgcttacaaatatgggtagtatttctagtcattccatcagattttattctgaaaaacacaaatttaccatttcaatatgaatacaggtaaaattcagcgccaggcaagctgtacatgattgaaagacatctgtgttttgaaaagcacgggcttttactcacatccatagtaatatgatcctaaatccactgtccccaggagaaagcaagatagcttttctccctgtcatgtcattacctatgcccagagttctcctcttgttcctctcatgaagcaaatcaatatctcacctttcatcccctccatacgtggttctgagctacttctatttatggcattatttagatatttttataatataagcaggaagcaagagggacagaaaaaaataatcagtggccaggtgtggtggctcacacttgtaatcccagcactttgcgaggccgaggcaaacggatcacctgaggtcaggagtttgagaccagcttgcccaacatagtgaaaccccgtctctactaaaaatacaaaaaattagcagggtgtggtggcgcgtgcctgtagtcccatctactcaggaggctgaggcaggagaatcacttgaacccaggaggcagaggttgcagtaagccgagatcgtgccactgcactccagactgggtgacagagcgagactccgtctcaaaaataaataaataaataaataaaaataataataatcaataacttggttcttctctattactttcaggaattttttaagtttctgatttcttccatggccattaggattttccacttatgtggcttccaaattattctaagtcagggagattttatgttttgttatcactcactttcagcttcactttagaattgcaagatttagattcaaagtgtgtaattaactgatggccttaggtaaaccctaacttatctgtatctcaatttgcatggatgaaacattcataatataaaagtatacaccacaaatatacctactcaaccaaactattggctccttaatgacaaagattaagtctctatatctttcctaactttgtacctaataggttcaaaataaatattttttgaatgaacaaattagtgagtcaacaatcagtcacccggttggccagtacctatggtgttttaagtgcaatctaccagataattcaaccttcataataaatagatttatcttgagattatcattgctataatagtgtagtagcatacttcatataagtttattttgtgaaccttaagaagctcaaggacaaacatctgtgtagtattcctaacattttctaaattgcatattttattttcatagaggtgctctacgtctttagtattgcttctaattctctcatatcactattttggacccttgggtctggctgtcttggaaaggtgaaaagaaaggtatggggaagaggatgtgttttaacaaagataattttatctgttcaagggattcaggaagtaattatcttaacatctgaatgctaacatctgaatattgtaaatacgtattctgtatgtacatgggagaaaatatctatatctgataccttttctatcatcacataaaggaactgacttctctggtttaaaatattaaccaaaatttatatgacaaaatcagtatatatgagtatatattttctcaaacctctttcaaacaggcctttttgggagacaagacacttatcaaaatcaaggctcttgacattaaatattcttgtttgtctttttttaaaaaaaagtcttcatttttctttcttttaaaatgcaataaattatactacaacatgcagtttatggtgagttattagatactgaaaaattggctttccattattttaatgcagattctacattgctttttttttactacataaagccatttgttttaagctccatgctacaaagaccacagatgttcattgcctagaacagtgtctgatacatagtagttgcttgaagtttgttaagtgactaaattaaagaggatcttacatataaccatgtttaaaattacatattgttatttatagtttttcccacatgataagaattattgccattttctttaacctctgacctccttgaaccaactatttctctctttttgtgggagttttatccttttgtatttaatctgaatcttttgaaattctaaagatacaatcacttaaccctctcttccatccactttcttttcttaatttcaggcaacaatgtgaaaataatggtgcttatgtctttgtaataacagaactttctttgtcttttctttggcctcattttaatcttcaatgactcatatttaagaaatgaactgtgcagctgtggtggatctaagtccttggcaacaactcgatgggcaaacacgtggtctctcacaatggatgctccttagctttgaattatttactgtccagttttaacaatggaattatatcatcaaatagtgccttggactttttaagtttttagtgccttaagtttttaagtttgatgagacctttaagatccatttccggccgggcgtggtggctcacgcctgtaatcccagcactttgggaggccaaggcgggcagatcacgaggttgggagatggagaccatcctggctaacacggtgaaaccccgtctctactaaaaatacaaaaaattagctgggcgtggtggcgggcgcctgtagtcccagctactcgggaggctgaggcaggagaatggcatgaacctgggaggtggagcttgcagtgagccgagattgcgccactgcactccagcctgggcgacagagcgagactccatctcaaaaaaaaaaaaaaaaaaaaaaaagatccatttccttattttacagaccttgttccaacaattatctccaccttctgtcaaggtcgtaacatatatctagggtgaccaactttcctcgttttcctgagactgtccaattttcctgaaactattctggttttaacatcgaaagtctctcatcctgaaaaactcaatgctggacaaaccaagatggttggttaccctactgctagcttccgtctttcactctaggttcaaatcattcctatgctaaaaagaacttcttatccctttgtcttgttatcctctctgtcctcctgtcgtgtcttcctcttttccttctcagaaaaagaaaattgaacatttgattttcacttgaaatacctactccttcttccactcactcctcagctatgcctacttctgaggcttctgccctccactgaaattgctctcagcacatctagtgaacactctgcaatgctgatcttactttacttctgtgtttcattggactcacttggtcaccctcttcctctcaaaattctcactctctccttgaaatttctacactcctcatttcccctaatctctccacctatttgttccttttctatctctcaagagatcctgttcctctgtttgcccattaaactttgatatgtaggcactcaacgtatattagctgaatgagaaaataactcctaagtattttttttctcctcaaacctcagaatttattatttccttgtggaaggaatgttagctttccaagctgagcatatcacagtcccttactctgtcccccatgcacagaacaccccccccacacacacacacacacaccatcatgttgcatttttaatattactcttcaataattttatcctgaatgagcatgaggggttctgaatcagaggcagatttcatttaattaccttacagtaaatattgttgctgtgcccttcctttgcccaaagacttacccctagggcaacatgatgaacgctgatgaaacattttcctacttgagtggctgggtactccataagtgggagactaggaaaaatcattttttctgcttataaaggagaaggaggctgctatccatctctcattctgaaaggttctctgtggaaacataacaggcctgagtcctaattccagcttctgcagaaaccagctagccctgtgtgtctcatgttttacaatctggaaatgtctccaaggtatgggcttcatattttttgaaatgtaaatacctagaaagatacccactccagtctttctaacaacatagagttcagcttaggaacctaccctgagctataaccgtttgaccctcttggatcagagaaatgaactagacaaattgctacagatctaatctccatggtgtgggaagtttctcaggaggctagagctttctgtaggtgaactgagacatccaggaaagtttatttcctcatacttagttgaattgcacccagcgtttgctcatctactcaacctagacactaagtgtcattcttgtttctttttctctcttctctccagcatctattcagtcaccaaattttcacacttcagatttttagacatttccctatcctatccctgtcatttttcctggtaccattgccctgagtcaaatcctcataatcttgcactgaattcttacaattgcctcattatctctctgattccatttctgttcttctcaaatacatactctgtatttatatcaggaagatctatttgaagcacacatattcctgtgccactcccttggttaaaaccgttcaaaggttcctgattaccttcaaggcaacacctaagcctcttagtggaccatatgtgatcatagagaggcagagcttcaaattctggtttaaaaatctaatgtatttccagatagcaatagtgtctttttcatctttggacatgccctctccttgttctttatgctctagaaacactggcctgcttgagattccgatacataccatactgcactatgtcctatgactctgcacttgcattttcctcttcttggaatgttctctagcatactcttccttgaataagtcatgttcatgcttttgaattctatgtgattactagcttctcctggaagcttttcccgattttcttccccatattgcgcaagtctatagcactgtctacattgtattgaaattatttacgtgtctgactcttctattatatgttaaatattcctaaatagaaagggctgttttgcattcaactttgtatttccagtttcaggtacaaccactgacacatggtagttcaatagagggagccattattatttttataattagtaatgtcagtattaattgcctcccttcaggtccaaacagagaaactaggcaaaatgataatttacttgaatttgggaaacttaattgtatgaaaaaaaacacaagaatacaacaactgaacacacacacacacacacacacacacacacacacacacacacaaacatggagatttcaagtgaaatatcaggagaatcagctttatatgtaagcagagtaaataactcacgtatctagcatgattttagggtacagaaatatcccattattcagaaagtacttccctatctgtaggctgaatcctaatattctacttacagaactccagtattttggttcaaacgccttccctttctctattgaattgtaaatagctgtggatgatgaatcattttgcaaagtatcagactcaggattcttttgaatggtgaacaccgctaagattttattaataaatgtgtcatacaatacagctctggaacacttctgtaacataatggcatatctgaaattcaaggaagaatactgctaatttgtttttccccagtgaaagaacagggcttaaattcagcaggcaacattgctaaaagacagagttgaaaaaagttacaaaaattaagccctagatcagggcaaatattactgttattgttaaacagttatattagcatttatgtagcatgcacttaatacttttattaataccctcacttctgagatcaaagaatctgggtcaataactctcttcaatggtgtcagagtatccgttaggttattctaggctcacggtatacctcacgatccttttagcactcgattatgtgtgaacttactgttttcactctgcttctagtgttaattttctcccttctttggatctagaaactttttgaaggcagaaactattcattttgtttttctcttgatcccctggataaaggaagattacagattaaagattaattctagatctgttcatttatagaaactagtgtccgcaattcctacatccataatagctcaaaacatttctactattctcaaagaggtcacaatggatgatgtaatgactatttttcaaaagtattgagacttttctcttagcttacctattttataccttgtcagacattttgacagaattaactggtgattgtcagttggattcattgtatactttaatatagcctaaggtcctgcaaatggcccttaaggcttcccattatgttctggatatccactatttggggtatgtttaagtcctcattagccatgctagagttttgcaatatataccttgaaactttagctgtagatttgaagtatggctgtcaggttacataaacaaagcactcttatctcaatgagagggcattaactatccagaatgctccccccatctccccagaatagctttacaaacacagcgctttcctcattaacagatagacccatatagcctttaaaaaaaatcattttataaccatcagtgtataaataaaagagatagaaattgacctgggagtttcataaacaagttctgagcacccaggattaattttgagaagaatgccacaagccaaataagcacttcttttcatctcatttcacaggccttcaagagggaattgaaaactaaagaacctgtaatcatgagtactcttgagactgtacgaatatttctgacagagcagcctttggaaggactagagaaactctaccaggagcccagaggtaattgaatgtggaactataataacatattgatagaaggatcagtggtgacggagcagcccatccattcttgctgccagggtctggatagctctcatattttcttggttaaatagaatcaattcaaattaaacatagatgctgaaaaaaaaataaggactcataaactaccatgcataaatcagtttgtgcattcataaataaacatcaaaagagattagcaatcagttattggaacatttagaaaataataaacaaagggagttatctgtgaggaggaattctattgttgcaaagactacaagttaattttccatttaagagcctgcctgaagtaaattagagcttgtggtatgcatcctaacgtttttctcctcaatagcttaagtgaatcttaaattgtcggattgatataaggtagaaactcaggaagatatactttagatgttctgggctgtatcaaaatttatgccaaagtataaaaaagccgttaatcagtaggttaccctcttgttcaactgtactctttctttcttccagtatgacctttttgacaatgtttaaaaaaaaagaatgtggcctaaaaccttgtcatattgccaatttagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggtaccgtctacttctttgcttcagggccctttgagagactcaaaagagcttctaatctgaacttgagtgcagtgttatcttcccacaaagttaaagctagagaaatcagtccgtctttcacaaattcagtcttcattcacatggtattttctccaagagaagacagtgatctaattatttgtctgtcttcagttatatgaaatgaaatattaaaacagttacagggcaagaaatcactttgactttgatattaagtgattgtactaaagtctgatgtgtgtgtgtgtgtgtgtgtgtgtgtgtgtgtgtattggtgtattgcttgtgttacttagtatcagaatacagaaaaataaaacacttaatcaaaagccaggagtctaggtgttggcccttttgctaaccaaattacatgacttgggtaagttatggtttggtgaaataaggctgttaatgtgttgcccttcccttggaaggcaacatttgtaatacagtttcaagtttcattggcccactgcagaaatgagggaaaatcattatatatttggaagaccactgtctataagaccaaagttaaattcccttgtggcacaaagatggcaaatatattctgtagaaaaaaatacatatttaggagtatcattttgaaatcagcaactactcatctattgtcaaaatcacaaaaatcctcctagattaaaattcaaaagaagttaaattccctcatgcactcagcatgtttgccagcatctcagcatcctcattctagaagttgtcctcttccttggctttcatggaactgttccatccatgttcttcttcctatatttttctagattcttctcctagccacccctcaaatactgttgtgcccaagtttctaaccttagcctaattctcttttgattgtttaaaccctccctgtttgagatggcctggatggtgatgtatctacatctctagtccgcatctctcttctgatctctgaatccatgtggcattacgatcacaaatgcaactattctgaaaccaagttcatttgttctcctgttttccatttccctacttctgtcccctcttatctgaccttttttttcctgtttcctatttcagttaatgaatcatcatccaacaaattttccaggctagaaactttaggttcatccttaaacccttctgcattttcactgatggcacatgatggctcatgttacctcagaatagctcttttgtgttttctctcctcttttaaccaatgtcctttttaatccccagcatcttttacttagatgataacagtatacatctttaaatcccattcacccctctgtgtgcctggcatatctcagatactgcattttaaacatttggtgaattaatggatggatgaatggtttctttgctgatgttcctgcattacccagcttcttccaattccaatccaaactccttgcgggagaatacttgcctagagaatgaaatccaatgaataaggagattacgtggcccttttcttcctagccttgacttaccttctcagccatagctcctattctccagaccatttaatacactctgcccatatgatatatatatatatgtgatggcatatttgggaaaaaggggtgatatgggcagagtgtattgaatgtgtgtgtctgtaaagtatgtgtgtgtgtgtgtgtatatatatatatatatatatatacacacacacacatacatagttagatatatacatagtatatatacatatatacatagatatacacatatatatacacatagatatagatatagatatatctgcctttgcaaatgctgttctctctgtctggatccccctacgttgtctacttggcgaattctccttcagccctcaaggaccagccaaaatgttacctatctttgttgtctttcctgagtgtctacaacccccaactcccaccaagcagaagaaactgcttacagttggtactctcatagatcaccaagcatgctaaattgtcacacttaaatttcacatatattgtagcaacttgcttatgcatttttttttctcccagagaaagtgaagttgctaagagcaaggatcatgctgtacatctttgggctgctagcccagggccagcaacatatgaggaatctcattaggtaccttcatttattcactcaacaactgtttatgagtcattatataatgtgctggacaggtagttataaaagaaacagacttgatcattgccttcatgaagcctatggtctaatgttgaattgcatagctcttcattaaaatagtaggtaaaatttttaaaaagaaaagattaaaaatttgactctaatacttgtaaaatcccttctaccccaatgttttatgaccccatgtctaacatttaaagtaagggttaaccttgctgtgtactggaaaactaagggttttgaaatgtattacctagtattttaaaagcattaaatatgttgattttattcaaaaatatagggactaattttttgacagacttctccaaaaatgagaaataagttaggaaaatgtcccagtggaactaaattagttaatatgtcaattaaattgctcaatagataggctgtagagcagacataagggattcatttttagccatacttgtcacacaggtgcatttgtaagatactgagtatggatggagaagagaatgtgtacagcataatttaataattaaaaataactaaaagcataacagttcaagtatcagctggccttcacccaaccctatttgcggtattccttttagtttccctgtcttatctgttcttggtcttaagacaaacttcattttccataccctgattggtaaaactctcattctgatcccaatgatagcaaaacatataaacattaaacatacctttcgaaaaattatatttataacccagcacatctatctttctcagacatatatacacttaagttatggtacttatctgaatttttatgtactggtaatagtagatgtgattgggcttttgaatctgtgttgtattttatgcgtgtttcaaactatgaattacatgaattcatatatatttatctcccttcggtagctcttctttaattttgcagtggaaataaatcatttttctccactgcatcttattgacactgggtttgaaactctgaagctttgggggtagtagtttacaaagaatgagttttattaactaaaatttatttcagaaaaaaagtagaagtgtacttgaaaccactcttcccatttttccactcagcaatttaagccctcagaggattcatgctgtagggaacttttctaataaaccatggtttctctttttttattttattttattttattttattttattttattttattttttttttgcgacagtctcgctctgtcacccaggctggagtgcagtggtgctatctcggctcactgcaacctccacctcctgggctcaagcagttctccgcctcagcctcccaaatagctgggactacaggcgcccaccaccatgcccagctatttttttttttttgtattttttagtagagatggggtttcaccatgttggccaggctagtctcgaacttctgacctcaggtgatccactcaccttggcctcccaaagtggattacagcactgataactaggcagctagctagaagaacattttatatatccatatcagttcattttccttacccctagacactctatcatagtaccccccctccattctgatcttatgtgttaaataacttgttattcaagaaactaagtaatatgtgtttctgtgagatttagcattctgtaattgtattagcaaatgtggcttttggatttaaagaatgggtgaaacaacaatgactaagtccctggcctttatggaaatggcattattgctagctgatcatctgcgggtggtgaacatggtaaattaataaatggaaacacaatattaatattgactatattgctcactaagagaatctcagccttccaaacatagcttccataggaaaaaacagtagaatcaaatttaagttttaaatgcttctttacttttaaaattcatgatttatactgcttatcaaatattttaagggcaagatcatgacttttcactttactgaaaatagcaccagtgcttatttgactagacaaatattctaccttccttgtaatggggaataggaataactttttgaattactaggtgttccacatagatctgtaagtggaatatataaaggctttaataaagtagaataacttttaaacctgtagtctggatacaagatttttgttcttcaggacaatcccaaggtgaaaaggtttgtggattgttgttttctttttttttttttttttgagacagagtctcactctgtcaccaggctggagtgcagtggtgagatctcggctcgctgaacctcctgggttcaagcaattctcctgcctcagcctcctgagtagctgggactacaggcgcgcaccaccacgcccagctgatttttgtaattttagtagagacggggtttcaccatgttggccaggatggtcttgatctcttgatctcgtgatccgcccaccttggcctcccaaagtgctgggattacaggcgtgagccaccgctcccggccagattgctgttttttaatgttttgtttttgttttaataaaccatggtttctctttttttaatttttttttttttgagacagtctcactctgtcacccaggctggagtgcagtggtgctgtctcggctcactgcaacctccgcctcctgggttcaagcaattctctgcctcagcctcctgagtagctgggattacagacatgtgccaccacgcctggctaattttttttttttttttggattttttagtagagatggggtttcaccacgttggccaggctggtctcgaacttctgacctcaggtgatccgttcaccttggcctcccaaagtgctgggattacaggcgtgagccactgcgcccagactataaaccatagtttctctgtaccaaaagtggtatgtccttcttgagccaggaatatttcactgttcttagtttacctgttgactctgaacacagtttttcatacactgtaaataactctcccaggctgccatcttggaatatgcaaatctgtcgcatctatgtagttatgcatatcgcatttttgtcaaacttttaacttgcatttcttactgtgaaaagtcagggcagggattctatgagttttttctttaaagttcctacaatgaaatgttttgattaaaccttttttggcattcaaattgagattgatttaatgatgtgtgtagtaggctagaaattatgatgaagtgacgatgccatccttatttatcttcagcattcacatctaaagttttaagaagaaaactggcaaatccacctttttaggcttaccatcctcagtccctgtggctttgggtttttttgagaaatttgtcaaagaaacgctatgttagaatttgacattgaggaagccaagcatatttcctctgaatagataatgtgaaatgtgatataatgtattagaatttcatcttcactttggcaagcaagatacttgcaaccatgttcatgcaactatcttcccttattgcttttctcttcttaaccttggttctaaagttttcttcttattgtattaattttgttatgcttcccatttatatgagtcaagtcaaccttacttgatttcttatatatgagttatgtaaggaaaacttatcttttcttatagaattaggggatgaatgagcagatagaaccaacatgaacagggcgatcctaaaaatcattcaaaacatgtaagctctcccaactctgaataaacttgtgatatcttcataatgaataaggtatactgcctatagtaggaagaggaaaatttattaatgttttgtgcattgttaaagaactacaaatgaattgccgtgtggaggctttcattgttgttgttgtaaaaatgctatgtgtattaagtaagcctttgatggagaagaaaaaacaaagaaaaaatatttaatccttcataaatctgggttaaatatgaagctaattcctgttatttggagtaaccagggttttatctagtttacaaagcatgcaattgcaatgtttaaaagcatatgatttggcctttaatatctgaaaatatgtctatcaaaggccatattatagcgagtgtcactccatactttataagtacggtatatttttaatagaatgtttatgtactggtgataagagatgttactgggtttctaaaccagtactgtattaaggattttatgctattgtaagattatggattatgtgaattcatatatattgatttactttcagtagcttttcaatagaatatctagggtttaatacagcttagaaactaaagcaggaattattcatctttaaaatcctgaccaaagaagtggctggcaagatggctgaataggaacagctcaggtgcgcagcccctagtgagatcaacacagaaggtgggtgatttctgcatttccaactgcagtacccggctcatctcactgggactggttagacagtgggtgcagcccacagagggcgcagaagcacggtgggatgtcgcctcaccccggaagcacaaggggtcagggaattccctcccctagccaacagaagccgtgagggactgtgccctgaggaacggagcattccagcccagacactatgcttttcccacagcctccgcaacatgcagaccaggagattccctcgggtgcctacgccaccagggccctgggtttcaagcacaaaattgggcagctgtttgggcagacaccgagctagctgcaggcgtttttttcatatcccagcgtcacctggaacaccagcgagatagaaccattcactcccctggaaaggggactgaagtcagggagccaagtggtctagctcagtggatcccacccccaacggagcccagccagctaagatccactggcttgaaattctcgctgccagcacagcagtctgaagtggacctgggatactcaagcttagtgtggggaggggcacctgccattactgaagcttgagtaggcagttttcccctcacagtgtaaacaaagccgtcaagaagttctaactgggcggagctcaccgcagctcggcaaagccactgtagccagattgcctctctagattccttctctctgggcagggcatctctgaaagaaaggcagcagccccagtcaggggcttatagataaaactcccatctccctgggacagagcaccacggggaaggggcagctgtgggtgcagcatcagcagacttaaacgttcctgcctgctggctctgaagagagcagcagatctcccagcacagcactcgagctctgctaagggacagactgccttctcaagtggggtcctgacccccgtgcctcctgactgggagacacctcccagcaggggttgacagacaccctcatacaggagagctctggctggcatctggcaggtgcccctctgggatgaagcttccagaggaaggaacagacagcaatctttgctgttctgcagcttctgctggtgatactcaggcaaacagggtctggagtggacctccagcaaattccagcagacctgcagcagagggttcctgactgctagcatcaacatcaacaaaaaggacgtccacacaaaaaccccatctgaaggtcaccaacatcaaagaccaaaggtagataaatccacgaagatgaggaaaaaccagcacaaaaagcctgaaaattccaaaaaccggaacgcctcttctcctccaaatgatcacaactcctctccagcaagggaacaaaactggatggagaatgagtttgacgaattgacggaagtaggcttcagaaggtgggtaataacaaactcttacgagctaaaggagcgtgttctaacccaatgcaaggaagctaagaaccttaaaaaaaaggttagaggaattgctaactagaataaccagtttagagaggaacataaatgacctgaaggagctgagaaacacagcacgagaactttgtgaagcatacacaagtatcaatagccaaatcgaccaagcaaaagaaaggatatcagagactgaagatcaacttaatgaaataaagcatgaagagaagattactgaaaaaagaatgaaaaggaacaaacaaagccttcaagaaatatgggacgatgtgaaaagaccaaacctacatttgattggtgtacctgaaagtgatggggagaatggaaccaagttggaaaacactcttcaggttattatccaggagaacttccccaacctagcaagacaggccaacattcaaattcaggaaatatggagaacaccacaaagatactccttgagaagagcaacccaagacacataataatcggattcaccaaggttgaaatgaaggaaaaaatgttaagggcagccagagagaaaggtcaggctaccccaaaggaaagcccatcagactaacagcggatcatttggcagaaaccctacaagccagaagagagtgggggccaatattcaacattcttaaagaaaagaattttcaacccagaatttcatatccagccaaactaagcttcataagcaaagtagaaataaaatcctttacagacaagcaaatgctgagagattttgtcaccaccaggcctgccttacaagagcttctaatgaaggaagcactaaatatggaaaggaaaaactggtaccagccatggtaaaaacataacaaattgtaaagaccatcacactatgaagaaactgcatcaactaacgggcaaagtaaccagctagcatcataatgacaggatcaaattcacacataacaatattaaccttaaatgtaaacaggctaaatgccccaattaaaagacacagactggcaaattggataaagactcaagacccatcagtgtgctgtattcagaagacccacctcatgtgcagagacacacataggctcaaaataaagggatcgatgaatatttaccaagcagcaaatggaaagaaaaaaaaagcaggggttgcaatcctagtctcagacaaaacagactttaaaccaataaagatcaaaaaggacaaaaaaaatggtattacataatggtaaagtgatcaatgcaacaagaagagctaactatcctaaatatatatgcacccaatataggagcacccggattcataaagtaagttcttagagacctacaaagagacatagatgcccatacaataatagtgggagattttaacaccccactgtcaatattagacggatcaacgaaacagaaaattaacaaggatattcaggacttaaactcagctctggaccaagtggacttaatagacatctacagaactccccaccccaaatcaacagaatatacattattctcagcaccacatcacacttattataaaattgaccacataattggaagtaaaacactcctcagcaaatgcaaaaaaacagaaatcataagagtctctcagaccacagtacaatcaaattagaactcaggattaagaaactcactcaaaaccacacaactacatggaaactgagcaacctgctcctgaatgactgctggataaataaggaaattaaggcagaaatgaataagttctttcaaaccaatgagaataaatacacaacggaccagaatctctgggacacagctaaagcagtatttagagggaaatttacagcattaaaatccccacaggagaaagcaggaaatatctaaaattgacaccttaacatcacaattaaaagaagtagagaagcaagagcaaacaaattccaaagctagcagaagagaagaaataactacgatcagagcagaactgaaggagatagagacatgagaaatccttcaaaaaatcaatgaagccaggggctggttttttgaaaagattaacaaaatagatagactgctagccagactaataaagaagaaaagagagaagaatcagacagacacaagaaaaaatgataaaggggatattagctctcatcccacagaaatacaaactaccatcagagaatactataaacacctctacgcaaataaactagaaaatctagaagaaattgattaatttctggacacatacaccctcccaagactaaaccaggaagaaatcgaatccctgaatagaccaataacgagttctgaaattgaggcagtaattaatagcctaccaaccaaaaaaagcccaggaacagatggattcacagctgaattctaccagaggtacaaagaggagctggtaccattccttctgaaactattctaaacaataggaaaagagggactcctccctaactctttttatgaggccagcatcatcctgataccaaaacctggcagagacacaacagacaaagaaaatttcaggccaatatccctgatgaacatcaatgcgaaaatcctcaataaaatactggcaaaccgaatccagcagcacatgaaaaagcttatccagcatgatcaagttggcttcatccctgggatgccaggctggttcaacatacagaaatcaataaacataatccatcacttaaacagaaccaatgacaaaaaccacatgattatctcaatagaagcggaaaaggccttcaataaaattcaacaccccttcatgctaaaaactctcaataaattaggtactgatggaacgtatctcaaaataataagagctacttatgacaaacccacagccattatcatactgaatgggcaaaagctggaagcactccctttaaaaaccggcacaagacaaggatgccctctcccaccactcgtattcaacataatattggaagttttggccaggacaatcaggcaagggaaagaaataaagggtattcaaataggaagagaggaagtcagattgtctctgtttgcagctgacatgattgtatatttagaaaaccccatcgtctcaacccaaaatcttcttaagctgataagcaacttcagcaaagtctcaggatacaaaatcaatgtggaaaaatagtaagcattcctatacgccaataatagacaaagagagtgccaaatcatgagtgaattcccattcacaattgcttcaaagagaataaaatacctaggaatacaacttagaagggatgtgaaagacctcttcaaggagaactacaaaccactgctcaaggaaatgagagaggacaccacaaacaaatggaagaacattccatgctcatggataggaagaatcaatatcgtgaaaatggccatactgtccaaagtaatttatagattcaatgcagtctccatcaagctaccattgactttcttcacataattagaaaaactactttaaatttcatatggaaccaaaaaagagcccacatagccaagtcaatcctaagcaaaaagaacaaagctggaggcatcatgctacctgacttcaaactatactacaaggcttcagtaaccaaaacagtatggtattggtaccaaaacagatatatagaccaatggaacagaggcctcagaaataatgccacacatctacaaccatctgatctttgacaaacctgacaaaaacaagcaatggagaaaggattccctattcagtaaatggtgctgggtaaaccggctagccatctacagaaaactgaaactggaccccttccttacaccttatacaaaaattaactcaagacttaaacataaaacctaaaaccataaaaaccctagaagaaaacctaggcaataccattcaggatataggcatgggcaaagacttcacgactaaaacaccaaaagcaatggcaacaaaagccaaaattgacaaatggaatctaattaaactaaagagcttctgcacagcaaaagaaactatcatcagagtgaacaagcaacctacagaatgggagaaaatgtttgccatctattcatctgacaaagggctgatatccagaatctacaaggaacttaaacaaatttacaagaaaaaacctaatcaaaaattgggcaaaggatatgaacagacacttctcaaagtaagacatttatgcggccaacaaacatgaaaaaaagctcatcatcactggtgattagagaaatgcaaatcaaaacacaccagttacaatggcgatcattaaaaagtcaggaaacatcaggtgctggggaagatgtggagaaataggtgtgcttttacactgttggtgggagtgtaaattagttcaaccattgtggaagacagtgtggcaattcctcaaggatctagaaccagaagtaccatttgatccagcaatcccattactggttatatacccaaaggattataaatcattctactataaagacacatgcacatgtatgtttgttgcagcactgttcacaatagcaaagacttggaaccaacccaaatgctcatcaatgatagactggataaagaaaacgtggcacagatacaccatggaatactatgcagccataagaaaggatgagttcatgtccttggcagggacatggatgaagctggaagccatcaatctcagcaaactaacacaggaacagaaaaccaggcaccgcatgttctcactcgtaagtgggagttgaacaacgagagcccatggacacagggacgggaacatcacacaccggggcctgtcgaggggtgggaggttaggggagggatagcagtaagagaaatacctaatgtagatgacaggttgatgggtgcagcaaaccaccatggcatgtgtatacctatgtaacaaacctgcacgttctgcacatgtatcccagaacttaaagtataataataataaaaaaaaaatcctgaccaaattatttattcaatgtgaaattaattgtaagttagtgttgccaggagagcttattacttagttaccatgtattccctctcatctcctgctttgtttataaagctaaaagcaaattacttaggacagcaatgtcaaatcactttctttccccaaagcatctgattttagatagcgctgtgtgtgttttaaaagcccctacctcgacttaggcaaacagaaccttcgtttaccatgctattcccatcccgcctttgaaacttctgaaaaggcagagcggagtaattgtttcagacatctgcttagcatactttgaagtgcatataagttctttttcagtttcatttgaaccccagctgtcttcaccgaagtctataatcaatctgaattaagttgtcctacttctcctaataagtctcttattaagttctgcatcagcctcttagggagacttaaaagctaattcatgtagaattgccattttctactaattcacttgtcagctctccaaattccaacaaaaacaattgcaaagactattaatttggctcttcataaacaacttatgtaagtgtagtatacattggaaccaaacaaacgatttaaaacagtgggtgggaggaaatgagttgatggcattcaaaacgcttccttttttgactgttatgaaatgccttccacatcgaaagcataaagccatttatttaataagggaaacatccttctgcttttactttcatagatgagataatgactgaatgaactttgcttaaagacaggaaaaggctttagaacagttggaaaaggaacatgttctttttgtcattgaacttattttaatttggacttctttgtgttattttgatggactgtgataaaagaaggagctagaattggttattattgttattggattaaatcagagttgtacagctactcttctggtcatgggatatttaggagaacacgggtaatcaaaatgttcagctaatgagttcatctgattctactcaagaagtgtttaatcagataataaaaatttctccaaataataccatccttcctactatttgaaaacaaccatatcaacatctgatcctataatatgccaatcctgtttgctaggattttctgaaagctttgtttgtggtgggtaataactagaaatactattcctcaagagtctcgggtaataaaagattattcaaaaaacttaagtaatatactctcagtattagaggatatacaaatgcactcattcattaattcatgatatgattgaaacctatacccagagaagtctgatctcattatagagtgtgaacatttaatttatttcaaaaacaaaaattatattgagagttgtatagatggcatcttagttttcctgggaatattattatttagcaccaagctgagggagcaagaatttgtattagcttgtgtatacatgtgcatgtaccacattaactagaaacagtgctaaaatgtgagttatttatttaactgaaattccatatttcctaagaaaatggaatcacacagccaatatatatttttaattattttttgacatctaccaaagttgtgacaagaataaagttcacaattctgttactctcctaccgttcagtaaaacaggaaatgctttaagatcaaataacccaaggagttcgcttcttcctgtcatgcttgacaattacaattttcaaaatttaacagttagcattgacaccagtattatgccttacacaacctgaaattaactaagttaagtaatggcattgaataatttttcttggtaaatcagttttctgggtattatgggaacagttgtgtctgtgatactaatgtctctctcattttaatggggcctaagaaagaactttttcataataagattttttcatgttaaaataatatttttagttatagtttacacttactgcaggtttttctatttaaaagcatcttccgagagcagtgattcttaaacttatttacttcagttatcttaacagcatagaagacatagcctgacatctcccgcttccacttacctatctcctttttccatgagcatgaaatttctttgatgttcttgttttattttttaaatctcacatcaattttatggtattttccataatggattcatcatgttttaatatgaagatgctttttcttcaaattctgaagtaaggaatctttcagcacattcacctatggacatgaaagcgtaagttgagaatcacagtataaaggattgcccagtttttgcaggctttatctttttccatcaacttctgtcttttatgtacacagacaaaaagagcagacccttgctatttcaaatttatcttttgcaggttcatctgattattgtgatccaaagttccatgactagcagctcttaattttgaacatgtattatttcaagcttttgtgcatagtcacttaactaatgagttaaatggcattttaagtcaggttccatgaacgcagaccctgagaacaggggtctaggtgcctgtgatttatagagggtctgctctcaggagaagcctgtattggagttagggaaacaatacaggagaagaaagagcccagcaagtatgccatttcaggtgaaacctcacattgtgtctgatccagagagagagcaagccctcgagcagaaacctcgctgtggagttgtactctttattttattttatttttttgagatggagtttcgctcttgttgcccaggctggagtgcaatctcagctcactgcaacctccgcctcccaggttcaagtgattctcctgcctcagcctcctgagtagctgggattacaggcatgcaccgccacgcctggctaatttttgtgtttttagtagagatggggtttcaccatgttagtcaggctggtcttgaactcctgacctcaggtgatctgcccacctcagcctcccaaagtgctgggattacaggcgtaagccacaacaccgagccggagttgtgcctttataccagtcattgtctgtgtcactgaagtgctggcaaatatttgtcgactagctctgaggtgggatgaatcctggtgtgtatcaaaaccagttttcgtggtgtaaatactccctctaccactgatctccagctaccgacataatgccactgagtatggaattgggaggagatgcacacaattggctcttgggctctgctgcagcacaccactggctgtggtccactcctgggatatgggttacttcctgggctagggggctcccataagcagaggtcacatgtggagaaggcaggtagctataagacattaatagtcaaccatcacagcagctgaaggatggatgcccaggttaggtaaagtgtcccctgcaactaataagtaaacctagtaatccactcactcttcatattcaacttggctttttttaatgctgttttgtttttgcatgtacagtaattctttataaataatgagaattttgtttctttatggaaaatccacctaccctccaccctaccatgaatagcttgatagctgttcatcagaattagtgatggaagagaagagttaatgaatgaaaaagtctaagaaagtgatcactattagtaagaaaatggcctcataagtgagtttggctttatagttatggaatctgtaaatgtctaggcattcagacatgtccagacatcattgagaatgtcaagaattttcagtggcaatggttctcacctcagcatacatcagaatcacctggagggcttgtagaaactcaggttggtgaaccccttccccagagttcctgattcaaaatgtctggggcaaggctaagaagtcccaacttgttcccaggtgttcatgatgctgctggttcagagatacattctgagaaccaatattccatagtaaagctactgtgtatgtacctgaagacatattttgtgtagtgttagcgtttcttcaattacaagtaataaatatatcatttattatttcttttatatttatcaatatccagaagatttagtttaaaaatgaatgcaggcacacagcctcttgttggattgattaatagtttagatatgggagcatcatagggagcattgtttcgcttaggaaccttgaaatgaataaatggcttcttttctaaatctcacttgtggaagactttgacggtggtttatttcattttttcctgttggtattttaatgacactggtacaattttggggttgcttcagatgaccaacagcataacttgccttcccagtattaatttttaacgttaaaaatatttagtcatggccggccgtggtggctcacgcctgtaatcccagcactttgggaggccgaggtgggtgggttgcatgagctcaggagtttaagaccagcctggacaacatagtgaaacctcgtttggacaaaaaatacaaaaattaaccaggtgtggtggcatgtgtctgtagtcccagctacccgaaaggctggggcaggaggactgtttgagcacaggaggttgaggctgcagtgtgccctgttcactccactgtactccaggctgagtgacaaagcaagaccttgtctcaaactatatatatatttagtcacataacttttcactttgtgtaaatattttttgcatttaccaataaaaacaattacatttaaaaattctccttacacttttctaccaaacatactgatgataaaatagtactttatagagtttctgaatctaggatattaaaaatagttgggatcagtcaacactttttaagtaaaatctacttgctagatatgaatagctaacagcttctccaggagtgcctacattttataacttactttgtccaccccttgaggctctgtgttcagggggagggtatatttttgtgtatagaaatagagatgaggtgaaatagagatgaaatagagatgatgtgggatcaactgggagaaagtagaaaagagtcttagctgaagtggttgaggaaggaggatttttcccaaaatggtgcaaaaaacaatgtattaaatatctgtgaaaaagttcatggttgtggtatagggtgagtggtatatgaaaagagaattatgggataaactaatggaaacagatgtcttaaaatttgcttttaactttaaacaagagacatgaaacttaaacttttcccttatcctagaatctgggagaggagaaggatgagaaaaaatgaaattttacattagaagcaatttgattaatgttcaatggaaaatggaaatagctatggtcaaacccactcaaatcaagtgtacattaaataattgagttaactgaattaggcagagtaagggcacattgattttcagtgttgttgaaaattggtccacatatcattgttatgctttttgtttgtaaacctcaatatttattaagtttccacagtgtgctcagccctgaaacgccaaattctcttaaccagaatgaggctggaggatctaacactaagacagatttctattttcttttaaggaattgatttttatggtaattttttttcttcataaagttaagaacctgccagtcctgtttcgaaacacacttatttttagaagtttggttttccgggattatgcatcattatagactcaaatgactcatttagaacttttccctatcaaatattcacattctatcatcatgatcttaacacggcataagcaagttagtgaacagagtgaagtcaatttattggcaatatatgccgaagtacaggaattaagtagaaacaaaagtgaatgagagtctttggcaatacattgatgtgttttttttagaaccaatgataaactactgctgagtttcctttcatttacttttttcctactcttaaaacattgtaacccattttgagatctatccattgttgtgaacctaaagcctattaggtcttattaaataatacccatttaactgacctgtgatttaagtttcttatctgcccccaagcaagcagactgtatgcaacggcattttacctgcttcaccttctgcttgccagttggtttttggtcttcacatgtttctagcagggatggggctaaagcaagggagagaatggtccattgttttagactttcacaaacccaatatactagaatctccacaaaggttatccaatatcagggtgacttttgtgcatccaataaagcataaggttaaaagaaatacaggctaaacaaatgagcataaattactccgttggcttatgctgtgaataaaatattacctttggaaccatctcaattttttttttgtataaaggttgaaggaagacatttgcaaagtcgtttctcctataaaactgcctagggtttggggttgattgttgtatgcaagaggggtcttggtgaaatctgacccactttgaatctaaaattactgaattattagtgaaaagattattttaaaaagagttttgaactctttttcctactgaaattgtattctcctttagataatcaatgcagcatcacccccacagatttttgagggcactaaatcatactcctattttgaaaaagaaaaaagtctattactattaaatatatctgttagttgaatatcaatcactttttctaaagggtagatttggccaatgagtgatttttttttttttttttttttggaaatcacatctgagaacgttgtttagacagcttgacacttagactcatttgtgtaagtagtaatttattcatcatttgcatgtacttaactggacattatcatgatagcagttgtcataacagactattacaggatatgaatttagatattaccttaagatgtgatcataaaaatcagaataatatcttgaaaatatcaattttatggtgagaaaaatgacaaactgaataaactcttgactcaagaagctagacttttcacaacctcatgtattcacagaagtaaaaataacaactaataatgtgtccagagggcccacattgctcagaaatgaatacataagactttcttttcagcctcagaatatgatgaaaagaagatgaaccattatgatgttgcatagattttaatgaagaaaattcgttttctgttcctttcgtttgactttaagtagttgaacatcctgcttttttattttgtttgcaagaaataagaccattttagaaaggctaaaaacattaattacatttaggaactacaataatctgaaagtaaaattggatattaaaggacgtttttgcaatcctttttagccctcttctgtgtattatttttatcactgctcttaaaaatttgtattaatctttggttcatttctgccttagtatttctaagttaataatatattgaatgaaaaatcaaatcagtaaaaatccattttgtttcagtagtgagtgccttccccctagaaccaaaactaaataaatgtgctccatataaagcaaaccaggtacagcatattgcacgggtaactcacaattctagattcctctattaatcattattcagacatgcagaggtagcttaatttgctttaataagtgaaaacagaatctctttgagactgctatctgcaatattatactttgtcctgcattttcttggtcaaaaattgtattttatagccatgatatattttggcttggaatttgcttctttataagcctagttattaatagtcatcatttaaatgaaatgatatccattagccttaagctgcatgattacagagacttggtctatcttacgctgtatttccagtgcctagaacattccctggcatataataggtacccaataatagtttttggaataaatgaataaacaaatttgtgcaaaagcatagggcaaaatgctatcttttagatagcgtgacccttaaaaattattttgcaaataatttgctccatttgccaccagcttatttctggccattgttacttcttgtctctgcatacaaacactctgtgtctcttctcctttccacaatgaccacaagttatactgatctacttgagattttccaggtgactatttcatgtccagaggaacatgcctcttctagtgttcccctctgtgaatgatttcagtcaccttatctactcaggaggtctctcttcccctccatcagcatctttctctgcaccttccaaacccctatgactcaacttctcataatatggattgcattttttttaatgacccattaaattgtgtacctctgctaatgattgtgagtgtgttgagacttccatttttccagtggatgataggtatataatatatatatatatacacacacacacacacacacacacacacacacacacacacatatatgtgggcacagtatctagtggatataaagtaagtgttttcaagtgagtagtaattaaatctaagagttgccgagaaaatgccattcccgttttgtggacatcttcattctacattgtaaaggccacctcattcaagacccaccacaatcttgatcccagaaaacacccatgattcatcttttacagctgccctgtacttcatattttaagttattaaaggctatttgcttttcctcagacacacattaaactttcctacctcttaccctttgttcaagttctgaacacatatctttcttccccacactatgcttcctctttatcagtttcatgtacctactttccaatgtctagttcgaggagacgtttataaggctacatgatagaggttgcccctggggcgatgtgagaaatcagctccaaaaaggtagctacccggcaaaggatcttagtctgtgactctctcatggatgaacttattacctactgctttgcagagtctccctggactagcctgaataggaacttgtgtgactatatgtgaactaaaagaaggagaaatatgcctaaacttctcatccatctttgtaacagccctaaagtatgcatgttactatcccttttctacacaagtggaaaatatttgtaaatgaacttcgttacagtctaatatttgatgacttcttagttcatatcattatttaagtaacttttctttagtggaaaagcccaaaaattagggaggcagggagagagagagagagagagagagggatcatctgtaatctcagccccagcatctataatcccaatccctgcaagggcctctttgggcaaagaagaaaaaggcactgtgtttttgaagagatccccggtcctatgccaagcctaaccaatttggtagtagagcccaggctggatttcagttggtttgtagtcttctagtcttttcatatgtaaatatttttaatgcttttattcagtgttgttaaaatgccctccaaaagatgcactaacttgtgccaccaccaccaagcagaatatattttccttgaataggctacttcctctttttttcccactcactccatttttattttaaaaatccctggtagagaccaaaaactgaaatgttatattcttgcccaaagaatgagagatgcttcagaaattagcaaatgctccaatataaatcaagtgatagatataaataattcagatatgggataaggaaaatgggtagctttctcttatttaggaactctatgtcaggtttctgtgagaaactgtttacgaagcagtctgacaatagctattggtctgaagtattagtaattagtacagaagtgcctaattctcttgactgcttgttctttaataaaaatgtattgagggattatcatgtactatggcttggcatatactggtgaaaaacaataatgtaggattgccttaataaattttctggtcttgggaaggaacagacaatgaataaatgaataggcaaatatatatgtacttgcaaattgtgatcagggttcagaaggaaaatagggtgttgagagtcaaggaaaaaggagacactttacgtagggcaaccaactgggaataggctatctttaaaagtcacatctaactgagatcagaagtatatgaataagagccagctaggcataaagtggatatataaaactccaagcagagggaacagtgtatctgaaggttctaagtcaagagtaagcttgggccaggcacggtggctcatgcttgtaatcccaacactttgggaggccgaagtgggaggatcacttgagcccaggagtttgagaccagcctggaaaacatagagagatcccatctcgcaaaaaaaaaaaaaaaaaagaaaaagaaaaaactaacttaaaaatatatatatatcaatgccagtggtgtgtgcttgtagtcctggctaacttgggaggctgaagcaggaggatcgcttgagcccaggagtttgaggctgcagtgagctatgatcgcactgctgcactccagcctgggcgacagaaagaggccctgtctgaaaaataaaataaaaataaataaagaaataaaaagcttgatgagttctaggaactcaacattttctaacttcttattagaaatgccaaattctcaggcccaccttacacccactgaatcaaaagcactaagtgggactcagcagtctctgtgttaacaagccttccacatgacaatgagatgcacactattgtgtgagaatcactgccttagactgatgttttgagctatttaggggagggagagggcccattcagggacaatggtggttaacacatgtggctcagaccaagaaatgattgcaagcccaaaaacttgttaaatgtaaaacttcaggcgcagtggctcacgcctgtaatcccagcactttgggaggccgaggcgggtggatcatctgatgtcaggagttcaagaccagcctggccaacaaggtgaaacccagtctctagtaaaaatagaaaaattagccaggcatggtggtggtgtgcgcctgtaatcccagctacttgggaggttgaagcaggagaatcgcttgaacccacgaggcggaggttgcagtgagcccagatcgcaccattgcactccagccggggcgacaagagcaaaactctatctcaaaaaaaaagtaaaacttcatctgtctgaagtaacttctgaatttgaagataaacatcctcatggttgatattttaatggtttatggattattacttacttttaaggaagttaataggtttcattaactgccattttgcttcattttgtcacatataattaaaatttttcagacagaaaatattggtattttttctgtttccttagcaacctaaagcatgacctgcttaaatgacttatttgtgctcattaaaagcctttttgtgttaattgtgtatattttgtatttagcctctgtgaaacactcatgaactatctttttatttgttttaattgtgtcattggaaagcttgaagtattttgtggtttttttttttttttttttttttttgcttgttttttgtctataaaggggagataactggcagttgcagttaggattatagaaacattttcccaaggaaattaataaaatttgttcaagtttcttcttttacaaattgtacttatttttgattttttaaatagtggtaaaatacaaattacatgaagtttactatcttggctctatttaaatgtatacttccatggcattacatacatttacgttgttctgctgccatcaccaccatccatctccagaactcttctcatcttgcaaaactgaaactctatgtctattcaacgataatccccaccaggcatggtggctcacacctgtaatctcaacactttgggaggccaaggcaggcggatcacctgaggccaggagttcgagaccagcctggccaacatggtaaaaccccatctctactaaaaatacaaaaattagctgggcgtggtggtgcacacctgtaatcccagctacttgggaggctgaggcagcagaattgcttgaacctgggaggcggaggttgcagtgagctgagatcgagatcacaccactgcactccagcctgggcaacagagcgagactccatctcaaaaggaacaaaaaagaaaaaaccacagtaattccccattgcttcctgcccccagcccctggaaaccaccattctatttcctgtctataaatctgaatactcatttctatatcttctttggagaaatgtctattcaggttacttgctcattttttagtcaggtgatttgttttcttgctattgagttgtaggagttccttgtgtattttgaatactgaccccttaccgggtgtatggtttgcaaaatatcaattgctcctgctatgttcaacttgttcttaaaaataaaaacttttcctttgtggtcaatacttccctgttcctcatttccaaattttatacatgaaggaaatgtgagcacccagaaaagaaagaagatagacactgttaatatggccaagatataattcggcttttattataagaacattggagttacaagcttcatagaaagccatgtcctaaaagatgaagaattatgatcagtgcaaagagaaaatgttaaaaagaaaaagttatccttttatgtttgggtatatattctttttcgatattgtaaagagaaactagagttttttgttcttgtttttgagacagagttttgctcttgttgcccaggctggagtgcaatgttgcaatctcagctcactgcaacctccacctcccgggttcaagcaattctcctgcctcagcctccagagtggctgggattacaggtgtgcaccaccatgcccggctaatttttctgtttttagtagagacagggtttcactgtgttggccaggctcgtctgtaactcctgacctcaggtgatccacccacctcagcctcccaaagtgctaggattacaggcgtgagccaccgcacctggttgagattgttttttataaaaagatgtggattctttatggaaaacacagagcagttaattgctatttttttaatgtcacaaatttggaagcgtgttgagtctgagaagaaaccatagttaaaatataattactgataatcgcttgggaaataaaagccctaaatttcttcatgcctacaaacttaatattgttttcccaagatcttttttttgactttaacctttcttaagtgtttctgattatgctaaatctaggccattagttctgagtctgtttcattatttatattgttattcagtttactcgtcaaaagtgatcatgcccaaatatgaaagtttacaagaattgccctgaaaactgaacggaaggagacaacgaaaagaaactgcataatattttgccttcaggctatcacaataaaaactgttgctggaaaaaaatgcaatcacatcccttttttttttttaaagtacgtttcaatggcataatttattgtcgagaatgtctctaccagaagcataagtgatactaaaggcagagggttgtattcgctcagtctgcaaagtatcccctttgtcttagctccacacagtccctcagaatttggcagaaatgagggactcaactttcgagaaagggtgacaatcccagttttgttggagagctatgaaatagccccatagtgttagtaatgaaaattcacttaagaagtctcctgcaggcccggcacggtggctcaggcctgtaatcccagcactttgggaggcctacgtgggtggatcacctgaggtcaagagttcaagaccagcctggccaacatggtgaaaccccatctcttctaaaaatacaaaattagccaggcgtggtggcgggcacctgtaatcccagctactcaggaggctgaggcaggagaatcacttgaacccaggaggtagaagttgcagtgagccgagatcgtgccattgtactccagcctgggcagcaagagtgaaactccaccttggaaaaaaaaaaaaaaaaaggaaagaaaggaaggaaaggaaggaaggaaggaaggaaagaaaaaagagaaagaagtctcttgaaaaaaagaaaggaagaaagaaagaaagaaagaagtctcctgtataaaaaaaggaaagaaagaaaagaaggaaggaaggaagaaaagaaaagaaaagtctcctgaaaaaaaaaaaaaaacaaaatataagtgcttgacaactgaagttcaagggtaaaggctattgggaaagcagatgaagttaatctaagtaatggatgctgttggtgccccagtcagattcgttcactgggttggtgcacccattcctcagtgactctgagtattagctgctaaagcctcatggtttcacccctttccagagaacctccctcagccaaaaggaagccaccttgactggcatgtcccaccacaccttctctcttaaaaccaccaggggtacaaagggaaaacccctttgcctcatcatggcacctgctgttgtacaatttgtgatctgggaattcccatggggccagattgatgctggtctccagcccataccacatcccaacttaactttcttgccctgtcttcctgcttctctcactccctttttcttaagagcactcagactctgcttctcttaaacctggctgaaggcagtaggtatctgaaagaaaagctgtacctacattctgggcatcagagcagtcagggaaccaaccagaatgaaaagtcaaaaattacagataatgatggaagtctctgagcctgatacatttcatgaagggcttgcttacagctcaacttgtgtttctttttaattgtttcaacagcatttgagtagctcattccgcccaggtatttgagagattccagtaggcctctgatcctctggaaaaagcaagatacagtccttgactctcttggccccatgaggatgatatatctgctgagaaatgcaggagctgcaaaacatagctgggctgtacctgctgccaattcccgggtaattgcattctgtgagggcttccctgaaccacgaggaagagccccggaataagtactaaacaccagtatttataggacatgatttctaattgctcatccttgccttctcatgactagctcagcatgaagaatgctgggacttttctttcctagcacctcctctttttaggctgttttccaagagtcttggttaacaaacatttgtttgacaaggattcatggtagacagcaatgccattagtccctacttaagtaatatttgtaacataaatttctctgcacgtgtatgtagcccaagaataacacttcatttttggaacctagtaattttgaattcctagtaagtgagataggacgtctatgagttagcaggttaagattttaggaggaatatttaatatccctaagaagggaagtttttcaaacactgagtagcactatatatatttatatatatatagccagatttctatctatctatctatctatatatatatatatatatatatatatatatatatcacaccatttataaataaactcataagtggcaaatccagtagagctaatctgagcatcccagagtctcccctctctgtcgcttgtttgtgcagctactcctgctgtggccttttatggattatcctggacttctacaactgacccctctactttctctccatctacaagcttcattttgctttgctttcctcctaatccagtttagattccacagtatattttttcaattacatcctggctaatatcgaaactcccttatccctaaatgtgtgagccacagtcatctgacgaaaccccaaacctggatcaactgttttccccatgcttacatgcaacactgttggagaaaatgagaaagtcaggcagattggttctgctaaaaaatgttgaacctcatcctcaagtgggccctcaacactgtttgccaacctcattacatctcttaggtcaactccctctcacagtctctattacgattaattcaaatgttcccacttacccttaattcatgttttcattcagtgactattcattgcacaccaggcactgcacgctatgccaggcactgcagactatgccaggtctgttgattcctacttcacagaggaaataaaacccctccaagcagaattccctcaatttactctttctagtctttccaactgaccttctgtgctttgcagtaggaatgttctcttaactgtcaagtcaaaattcctccctcaaaaataagattcccttgttaatagacaattcctttattttcttagaaaagtagtagatgactataattttaaatgtgtatttgaacaaatccttagctacataaagataagcaaagatatgacaggcaatttaattttatatgaagaaaaacttattatatcagacttacctatcattctaaatcagtacttttgtatctataatcagacaacatttaatgaactgaaaattctgcctgtgagaaactagtcataataaaattagacttggtttgctctttcatggagaacatattccagatgtttaagtgattcaaagaaaacccacaatataatggctttcttcaatgttttctcacttactgcttccaaactagaaaaaaaacctaatgcaatcctgatatcacttaaatagcacctcgtattgctcagcgttaactgtgctttttgacattttaggtgtagtgtttaataatttaaacacaaatttatgtgtgtcatattaaaagctctaatctgtgaaatatagccaaaccaatgtcacatctatttaaatagcaaagtacctgtgttcaccctttacagggtgaaggtcttgtgactctgtgtttaggcggccatacttcttgttatgtatgctgctgggcactgagagcccacagtggtgagccatccttgggtggtaaaagctgctaccaaaacctaaatcaaatgccaaagtgaagactgacatgagcattctcctgcctccttttcctttttatctttcctaccatctgttatctcctttcttccaccttcatgcgttgagtgccctcatgatgatttctagctgactgaagtcctttagtctgctcaaccccatctagagacttccccaaagtgaacctttgcccccagttatctgtttatcaactgacctcacaccagtcaaagcttccattgtcaaatattttaacagaaatttaggaattcagattaaactgaatatttggcattttttcttttttttttttttttttttttggagacagagtcttgctgggtcacccaggctggagtgagtgcagtggtgccatcttggctcactgcaacctccacctcccaggttcaagcgcttctcatgcctcagccccctgagtagctggtactacaggcatgtgccaccacgcccgaataatttttgtatctttagtagagacagggtttcaccatgttggccagtctggtctcgaactgctgacctcaagtgatccacccatccacccacctcagcctcccaaagtgctgggattacagtcttgagccaccccacctggtctgggttgttttcttcatctttagcagttgtcttgttcacaactacttcaacaatatttattttctttttctttttgaagcaactctccagagtatttggcctggtttttatagaaataataacttttttcttttctttttaaactaatatttttatgatttaggaaatctttctttattaaattacataatcacaacagttactggcaaagataggtttgagaacatacacacaactgacggttgtaacaagtcaactgatgggagcagaaggtccacacatactgacaggcacctcgaacattttattgaggctgtgagaggttcccatcactgctgtttcacaaagagaatgaagactttggctaatttggtgagtcttaagtggagattagttcagagaacttccactatcattgcttgaaagaagcaaaaaaaaaaaaaaaaaaaaaaaaaatcccaagatcttatggtaaagtttaaagaagaaaagtaaattttaaaaagaaaaaaaaagaggaaaagggagagcattgcaattaattatgagtaccaaaacttatttttgaatccccttcatcctccaaaacattgaagcaggattaatatgtgtgctcaggaatttgggagagaaaatgaaaatcaaaatattctaataagagacatttgaaaatgtacattgtgtcacctaaagggaactgaaatctagctatggcttaacgaggtaggataatcaacttaatggcttgagagtcttgcttgtaaagagagatgattagcacaaaggactcacctgtatcactgaaagatgctgcctgctggcttgccctctctgcagaggttcctgtttacagtttcccctcacatgatatttatttgtggctactagaaatgcacgttattatccagaagagaatgatttcattttgtaaccgttgtccttgtccaagtttcccccattgacatttaagaaatctgttttctaacctttctattatgcaaaacaaaattaatatggatcatttccttttagagataagtattcatatatatggatttaaaccacctttctccatgggcccttattctgatacttttaatccatgtatttattcataaggaaatggaacaatatttactatccacccctataaaactttctgaatttcacactgattccagtgacattccactaacacgaagttgaatacagatgaatacatcacatatgattttttttttgcatgtgtatggtcagaaggggctctcttttgtttgtttttattaatatataattcacatactttaaaattcactctttcaaagtgtacaattcagtggtgtttagtatattcacaagattgtgccaccatcaccattgtttaataccagaacattttcgttatcgtccaaaagaaaccccctgattgcttaacgtaatgtttttaatgaccactttttaaaactttaagttcaacagagtgattatcacaatgttttgtattatctaagaactacacaacagtgttatgctctatacagcaccacggtttactgatgaagtattcaggttgatttgagaggataatgtcgttcttattttgaatgttcatactggctccttttatttggagtgggaggaaatgcaaggcttataaatgaggtcagtgtaaccaatggttttatcaacatagtgaaccagacagagaaataacacctgcccagatcaagcaagtcaaaacaacacgtatagtcaagtggtgctgtccttgtacacagacattacattacacaaactgttctcctaagtgagggaatttgtcccttagaaattgcttattggaacatttggacatcatgcatcatgttaaagatccataaatgccatctcgatagggtagatatgaggcgtggtaatatcctccccatatctgcatagggttcttctgctcaacggattgctatgatgtattgcatcagagactcctgctctagtgcttcaaagacagctgagaagccccacgggagccttctgaagtcattgctacaagggctaaaataccaggagatcaggaagtcattctgaggacttgacaaaataccctactccctaaatgaaactgttatgatgtggttggtgcaaagtatgcatgcaatattttatgactgaatatatctttctattgtaaaaaataaggatccatttctggttgtgacatgagtagaatttagaatccagcagcaatatatttttcttgttactttgccaatccagaatttcttaggggaagcatataacataatagttaagaatatatattctagaggcaggcaaacctgcatataggtatcccaggttcctcaatttttacccatgagagcttggcaaggtttgtttgttttgaaaacaaacctctgcaagtttgttttctcatgtataaaattagaattctccaactactggcctcataggattgttgggtagaaataaaatcagtttatgtatgaatagagctcatcatggcattaggcacctaggaagtgctcaacaaatagtagttatcattattcccccattaacaaatatccattgttataatactaccacaagagactgtcttagtctgttccagctgctataatagaaatgccataaattggatagcttgtgaaacaacaaaaacttatttctcactgttctggaggttgagaagtccaagatcaaaataccagcagatttggtgtctggggaaggcccattcctcatacaaagcaccttctcactgcaccctcacatgctgaaaggagctagctagctctctgaggtctcttttataagggcgctaatcccaaaaatcacctccctaaaggccccatctcctaataccattgccttaggtgttttgatttcgtttcctttttattttttaggatttcaacataggaatttgaggggggacacaaacattcaaaccgtagcatagagcaaacattactggcactgcaccctaaagagaataagcccaggtatcagttcttcttgttttaaatattctcatcttccaatttgcttttgactattgcacacaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtaagcacattgtaaacattgttgtcctttgttacagtaaaataatatacagataaaatttgtaaagaacaatgaaagtacttttttcatgtaatgttcatggtaatatttgtgaggataggatattttatattagtttataattcccatctaaacattttcaaattattaatattaattttggaagcaactaagacttagtatatgtcttagtctgtttagtgttgctataaaagaatacttggggctgggtaattcataaagaacaggtgtttatttggctcagttctgcaggctgtacaagaagcatctgcttctggcgagggcgtcaggctgcttccactcatggcagaaggcaaaggggagctggtgtacaaagatcacacggcaagagaggaggagaaaaagagggaggggaggtgccagttctcatgaaaactgctagagcaaaacctcgctcactaccgtgagaatggcaccaaaccattcatgagggattcactcctacaacccagacaccttccactaggcctcaccaccaacacgggggatcagatttcaacacgcgagttagagggaacatccaaactctgtgtagcagtattcttacgataaacagaaaataatgctgaatcatgatggaagatgtgaattgccaccatgcagttcctttgtactcttactgcttggattctcaaaaacatctttccctttagaatcctaatttaaacaagagtcaatagtaagatgtgtccaaaagtcatttaaagaaagagcatcctatcacaaacttacatgtggaagtttttcgtaggtttgcgtaataaatacaggcaatgtaagtgtgctgctcaaggtcacacttactagccatgggacctggagcaaattacttaacctttctgagcctcagtctttcatcaaaaaaaaaaaaatgcgataataaaattctctgcaatatcagtttattattaggatgaataagtcaaaataaatggaaagtgctcgggagcgaacatgccaaatgataaacactctacaaattctagctcttgatgttgttattattattattattacagtacacaggttttggaatccaacatattagctgagtgaccttgaggccacttaatctctgtggttgtccatttactcatctctaacatggttactgtaacatcgaatgagttaattcatgcagagtaatggttgtagtggtggaagaggtgcgtctaccttctcagtgtgaaggacaccatgttataccccaaaaccctaaaattagtttaaccgtagaattagagaatcattttctctcctttccaattttctcctttccaacaggatgcagaaggtatgcctctgaggaaactgggtttaaaactatttggttttaactttttaataagaaaaatataataaaccaaatcactttcctattgtcagtccatttaggggtgtgattgagaggcctgttaaagaattgctagatctttaataaagataagttgcaaatcccagacctcttgagatctcacataatttaattcttgttgtgatggatagtcctgaaagatttgtattctagattgttataagtggcatcgactaaagcaaggcgatatagctaagtgattatatgcctttctctgtttgctccatagtagttgagtactattaaaattttatctgttccatccttagtatgtttttcatcttaagtataaataaggaaagtaataaatgtccaaagaaaaccaatggccacattagtcccatataagtgttctagaagtatattttataatttcttttagagagcagaatgccacgtttgctttcagaacgtggtaaaagatttgtgacagtggcaggtagatttccaaatgaggtcaaaggattatgactagtaagaaaagtttttttttttttaatcaatgctaagtgatccattctagttgcactatttatttgcatttaaggtatcaaaaacagtaaatagcttactatgtagccattctttacaatgagtaaaaacttggttataagtacaggaaaacacatgtaaggagatagtatgatatagcgaaaagagcattggattgactattaggaggtctaacttcaaacttaagctcagccattatttgaccgtgttattgtgagaaagccatttaacctctctcagctttaattctcctcatttttaaaatgcagaaatctattttgtctaaggtcacatacagttcaatcttatgattctgtctctagatatctgggggagatacacatttgacagaatttagtttaaaaccaatgaagttcctttctttattcataatacaaatgtggtttgttgaaattatatttctccttgtataactctaacttttaatctcttcttccctaaacccacatatacacagccttctcctattaaacagttcagtttgtggtgtctgctctatattgtagcaaatttcatgtttctatttttgaacatgaccttaaagatatgcttaaaaagtgtttttagcagaaagctgataaatccaaggttttggtttgcatataaccgagtcaagttagttccattcttttctttgatagtaattctgctacattataaatgtgaggccttgttcagaaagagaagaaagcaagaaatgaggttcacatcaagcaatttttttcccattactggaaaagcaattcatacatcctgttgagaatattttatatttagaacaatgtatgtgaggctaacgcattatccaagttctatggcgggaagcttgagcccaccaccattatgacatcatatttttttaaatagtaaatgtcaaaaaagacatatttctatgaaaataaagaatttagtcacaatgctatgtcaatctttaaatcgtgataaaaaccaagtacaagttcatctttgcctctgtccactaagacaaagaacaatcaaaaagtaaagaactctctgggcatggtggctcacgcctgtaatcccagcactttgggaggccgaggcaggcggatcacttgaggtcaggagtttgacaccagcctgaccagcatggtgaaacctcatctctactaaaaatacaaaacttacctgggtgtggtggtgcgtgcctgtaatcctagctactctggaggctgaggcaggagaattgcttgaaaccaggaggcagaggttgcagtgagctgagatcgtgccactgcactccagcctgggcgacagagccagactcggtctcaaaaataaaataaaataaaataaaaatagagaactggagtagtagaaaggcagatgtaaacctgagaaaagaagaagagtcttaaatttgggcaaaatagtataatagaaagattagagttacatactatcaggccgtgtctacttgatatcagaatatcctgggttctttgcattatccattcatttaattttcaaggaaagccatgctagttttttagctgtctgtaatatcagtcaaaatggtgaaaccagttaagggatgtgagcaccaacaatacagtcaaacccagtcacaatttacctatgtatagaatcataatgtatagagaattccaaactgactttgaatcttctaatagaaatgtaagagacattggtttgcctgtttgaaattttctgtgggaatgaagtcctattttcttcctcaaagtagacacattggtatgcatgttactatttgaccatttgactttttgtggtgtaggaaaccatcactccttgcagttagaaaaagtcctcatgtgcattctctcatctaagaatcacaaccttgtgattttgtattatgattatgattacctattatcattattcccttttacgtgtaaggaaaccgaggcttagaaacatgaagtaccacagtcacagtcacataacttgtatcagtcaagatctgagtcaggtttttcgaactgctattcccatgctctttttgtctcctcttctcaaaatcctattacgtttggacttaacaaagcaataatggctgggtgtggtggctcacgcctgtaatcccagtactttgggagggtgaggcgggtggatcacttgagatcaggagttcaagaccggcctggccaacacatagtgaaaccccatcactactaaaaatacaaaaattagctgggtgtggtggcgcacgcttgtagatcagctacttgggaagctgaggcaggagaatcgcttgaacccgggaggcggatgttgcagtaagctgagatcatgccactgcactccagcctgggcaacagagcaagacaccatttccaaaaaaaaaaaaaaaaagcaatactttaaaactattttggacaatacaggtgtaaaatacttcacttttttacatgtatcttcttttttgaaatgattcttaggtatattaacttttaaatcttccttttataaaccaatggattaatgaacccagttcagtgtaccccttagaaatcacacttgtttcaaatataaaattttaaagcattatattcctcattgcctttagaactcagcaattgtactaaaatcagccaaaagtgatttcagtgaatcagctcttaaagccaaactaatgctaatatttgaccaagtagaaacgaatatctaaaccaggtgagaaaaaagttaaaatgatgataaacctttctaattttgaaatagtacacacactgagtaatgcagtcaatctctttattcaccaagcgcaagtagtatataaaggaatattataccatttttctttactcatgagtaaacccacaaatagcacaaaagctgcaaaaacactttaacataaggagtatttgttttattgactgtaggaactcatggaatgcaaacacctttaaaatctgaataatatgaaggcatttccagctattagattctttacatatgtcaaagaacagtatcataaattatgtatgttttttaaaggtttcctaagcttcttccaaagtcatgtagacatcattacactccatctgtatacctctgtggtaacttgctgtcgcagggatctagagcctcatcttttgcaaacttcattccttctttcatccctttgttctttcattcagtcagcactgattgagcatctactgtgtacctagaagacattgtaatgatcctgtttggtccaaggacatactaaacaaaactccctttactgcttatgctatattaagtaaagctttaaagatgggttctcttttattacttccatgatggcccacccctctcatcctttctcagtgttaaaaaccagaaatatacatacttacatactatcataacactgatactacaaaagcagtacccattattatctctggtttacaaattattcaataatttcttactggaaacttggtctatatagtcatagtagtaagctttgtgagaggatgtgatgggatcatagttagctaaacaataggagtatttgtgtggcttcattttaaaaaaactaaccagtttttttccaacaagcaattcttatatcagaaccatttatattctttactttggtgagataggattttctaagcaggtcttttatctgtatctatgtatgtttgttcttaccatcattgagcacaggatttgatcctttaaatgtgttgacagattttgaacattttcctcatatctttcttttttgttttttaatgatcctgtactaatcattttgcattatggggtcacttctggacagagagcctagccatctgctcttacaaataatgtcggcctatcactaactggggataaggagaagacatctaccgatgtctttctagcatgtccttcttgactttttctttctttaagaagactaaaatgattcagcttgtggttctaccacagaactcaggagaaaatgataaatatgaggccattctccaaataaatatgttttcctacattagtggttctcaaattttaacaagcatcaaattcacctggaaggcttattaaaacacagataactgggctccacataccaagtttcaaatgattcagtgggtctggtgtggagcttgagaatctgcatctctaacaaactttcaagtgaggctaatgctgctgaatcatggaccacactttgataacccctgttctatgttaagtacttgtcaggtacagacaaatttaaaagttaaaaaaatatatatatgacttctgtaagacactgtgaagggtttagactctggggaaattaagtataatgccatcccaaaaactctgtgttggaggagtgttcaagtgctgcaggatcatggagaaccaagcacttaacttttctatgaggcagaaagaggaagataaagggaaacgtggaggatgaagggaaactgttaatagatccccagaaacacaatttgctgctatatggatttatatttactgtatttcaaatcacatggtctagaactgtgctgtccaatatgatagctacatatggccattgagcccttcaatgtagccagtcgaaagtgagatgtgtagtaagcgtaatatatacacatgtaatatgtatatgttatatatatgatatagatgtaatatgtatgttatatatatgatatatatgtaatatgtatatgttatatatatatatatatatcaggatgcaaagacttagtaccaaaaaaagaatgtaaaatatctcattatttttatattgattacatgttgaaatgatagtatttttatgtatttgcttgggtaaaatgtcataatgaatttcactcatttattatgattattcaaacttggttatttttcttgaaaatgaatgaagtgagcctgttgcttcggctacaacaatgggcagtgtttctgcaaaatttttacatgtgcctactagaacatttaaaattgtacatgtagcactcattatatttctgttggatagcattggcctaaaagttttcaaaatctagcatggataagaatcacctgcaaagcttgttaaaccaatccgcccccagaaatttagtatcgggtgaggcctgcaattctgcatttctatcatgctcccaggagatgctgtctatttgtaaccacatatagaaattcattcccaaactacagatgatagagttttacagagaggtgcaaaaatatatttttgcatcaagcattgtctgtagcttgaatacaaaattatgttgcccatataccactggtttttgtaagtaaagcagttgtgttacaaagcatacaagtttttatcagctaatagccttttctcaattagcagatactaagtagtacttttattatgtggcaattctccagtttttggaatgttattgagaaatacacagggttaaaacaaattagaaagcacctctcccaaaatactgcagtaagatgtaggaaaaactgctctaacatattctaaactataggttgctcttatgtaaatatttcaactataatatctagtctgatgtgcccactggccagagttttgtaaaagctaaaagtaaaggaaataaaaaaaagaaagaagtatgtgtttgtttttgaaaaggttaggtcacagaaggatttgttgatattaggaatagaatgacccgtgaaaaaaggacaattaagttccaggaaaacatcttttcagtaaggagagaataatcatttatgcttaacctcaactctgttaggaaaaaaaggatgtaaacaaaaccctttaaagaattgaagaaggagagtataaatttaaatgcccaggttagtgaccacccttagagcatactgaggtcaaagcgtactgtcaagcttaagaacatttggttttcaatgtttgtacaactaattgtactttagtcaagaggactgttatcgaaattgctcaggtagccttgaaactaatatggcccaaatattccagagtctgtctttctcaccctaggagaagaatggtctggttttcaagggaattctctattttttttttttgaaggcatcaggatgtgtgaaactacagggggataaatgaacgatgtacagaatgtgatgaaaaaattatatgaagtataaaatgggaatgaagccatcaggagccaaagaaatatttatgaatttaagagaatgaaaagcatattattattttcagatattttataaagtgaacccaaatcattataaagtattaattaggctacttgattgcttgatctttatatactaatttctaatttgttttaatcgggaactatttttgctagttctaaggctagctattatggtaatccatgtaagtgtgtttattattgtttttaaaaatggaatgtgttcctagtaaatgtgtttaaatagcaaaatgtatttatgcatgcatgtatttattttagtttcctgagacctctagttccttactagaaacatgtatataattccaggcatttaaaattgccatgatggtcatgttttcttgtccttttcccttattctgcaactgacatttgcccttgtctccaatttctcactgctttattctttgttcttgtaagtgttcttgtctctctgggctgacctctctccttccctggagtttgaccccgccccaccctttcttctgcatttgtttgcactggttgttttcttcattgcctttcccactgccccgctgcgctgcatgtgaaacactccgccagtagctgctcacagttcccatgctacatcatacccagcattcaaagagctgctgttctcacatggccgccagtaagattcccgactcctccttcacagcacattcctctagaaagtagaaagaatcccctttcaggccacatgagaagctgcgtgttaaagccaactccataaaggggaatggaaactagcgtatgaaattcagaaatgctacttttaaaggtaaataccacaaagtgaatttcaaattcatacagtttatcataatacttctttatttttataaatgctataatgtccttaatataatgatcactgtgatataagttgtcctctcccttaatatattaattaatttactaaaggagacgggagggtggaaatataataaattagaagatgattcttatatcagaagtacagcctttatacatagttttactttattcagacaatcaatgtagtcatatggtataaatttgaaaataattttagtgagcattacgcttactgagattaatagtgagaacttacctagcacttactgtatgccattcacaattataagcacttttgcatgtgctaatgcttttaagcctcacgtaacccagtgagggaggtacaattttaacctcattttacaggttagaaaaatgaggagcccaagggttaagtgacttgcctgtggtcatatatcaggtaagtgagagagccaggatttgaacccagacagtctgcctggggaatctgtcagaactcctaactatgcagtaccactcctctgataaaaagttgaattgacatgacaacatttcctattcatttatgattcgaccctttaaacaaaaagaacagcatcattctcacatttattaatttgtcaggaatcacctggatcatgagttgaggaaatttaaagtaggagggttgtatgaatttcagaccacgatctcaagaattgcctgtttaactcagagcctgaatcattcacagactaaaaactagaatcactcttctgtaggaccaagagggttgaatcatcaaagtcttgctgaagtgaacggaaatcctcctttgttcaatcattcattcaataattatttttttctggtgtctactctttaccaaactctgtttgagatgatagggattcagtcatagacagaccttctctgccctcatggaggttatggtttcttgggatgacagacagtaattttttaaatctcataaaataattacaaatgtgtcaggaaagaaaatacaggacactaccagaatatatagtaaggacctaaatgtgtgtgtgtgtgtgtgtgtgtgtgtgtgtgtgtgtgtgtgtgtgtgtgtgtgtgcgcgcgcgctgcagtaagggtgagaggcaggaaagggcaatcaggacaccctcccaataaaagtgacctttgaccgagatctgaaggatgaagacaagctgagtgactcttctattcatctatatcttttgttttaaatggcctgaagcctgggactaactaaacagggttgtaaaattccagtatgtaaattgaataactagggatcatttgaagtaatggactgcagagttaatgtataattaagtcacatctagggaagatttcccatcattatcacagagagcatcctgtttgctttcttcacagcacttacgaaaatctatagctatgtgtttggtggcttgtttaatgaaagtctgtttcccctatctgaatgtgagctccataaggacagaggccctgaataccacatctactgacatttggcagtgtctttcatatagtaagcattctataaatgtcttgaatagatgaatgcataaaactaagttaaaatgttactgaaaactataaaaataagcagaaagttataccagaggagaaaaattaggggaaaaaaactataatttctgaagacgtagtacttacatctaaatttgtggcttcataaggttaaccaacacttaaatagttttgccaaaactccaagaaaaaaatgaccgggtgtcgtggctcacgcctgtgatcccagcactttgggaggtcgaggtgggtggatcacctgaggttaggagttcgagaccagcctggccaacatggtgaaaccctatctctactaaaaatacaaaaaaattagccgggcatggtggcagacacctgtaatcccagttactcggaaggctgaggcaggagaaccacttgaacataggaggcggaggttgcagtgagccgagatcatgccactgcactccagcctgggcaacagagcaagactctgtctcaaaaaaaaaaaaaagaaagaaagaaaaaaaagaactaccatttgacccagcacttccattacttggtatgtacccaaagaaatataaatttttctaccaaaaagacgtgcgctcatatgttcattgcagcactattcacaatagcaaagacataaagtcaacctaggtgcccatcaatggtggattggataaagaaaacgtggcatatatgcaccatggaatactacacagctatgaaaaagaaggaaatcatgtcctctgtagcaacatggttggaactggaggtcattatcctaagcgaattaaagcagaaacagaaaaccaaataatgcatgtgctcacttataagcaggagctaacctttgggtacacatggatgtaaagttgggaacaacaggcactagtgacaagggcaggagggtgtgggacaagggctgaaaaaactacctatcgagtactatactcactacctgggtgacaggttcaactgtactccaaacctcagtgtcacacaatatacccatgtaataaacctgcacatgtaccccttgagtctaaaataaaaattgaaatctaaaaatataaaatatcaaatcataaaaataaataagaaaacaattgaatctactgatatgtttcattgcttttaaaatatccactttgaattactgaatattttaatatttttagttttacacttcagcacagaaagtccagaaatccaacccttgagtttacaaagacaccacatgatagttcatagttcacacagctagttagttgtggaactagaacccaaaatttgctctctatgtctctcacataccttttccctttattctaataaaggcatttgtcagtctaaatgtacaatattcgaagacattttttaaaggaactacttatccaaatcccacctgtcttacaaggtccatgtgaagcaatgagataaggtctgtgaaactgcttccgaaactatcaaatgttataaaaatgttaagttttattattagaactgcagttcatctctatgaaacctttctaaactttctcacttttctgaacttgactacgcagcgtcttttctaatctatttgttctccctttataagaagaatttaatcctttccgccctgctgggttgtaagaaaaaggactctcttcttttctataatctattgatatttgattatattacacatctaatgggttcccaataaatacatagtgaatagaattgaaccaaatttctttctagacatgtgaaaaaaaatcctgatctttaaatagaaagggtactttcaaagattatatatagaacctcttggtattttgtatttgcaatgaaaatattttaatttgggccaggtgcggtggctcacacctgtggtcccagcactctgggaggccgaggtgagcagatcatgaggtcaggcgttcgagaccagcctgaccaacatggtaaaaccccgtctcaatcaaaaatacaaaaattagccaggcatggtgacgcatgcctgtaatcccaactactcaggaggctgaggcaggagaatcacttgaacccgggaggtggaggttgcagtgagctgagatcatgccactgcactccagcctgggtagagagggagactccatctaaaaaagaaagaaagagagagagagaaagaaaagaaaagaaagaaaatattttaatttgtcttatgttcaacagttgcatcatatctgcatccttttgttaaaattgaacaggcttctagtttcatataataatttctggccaggcgcagtggctcacgcctgtaatcccagcactttgggaggccgaggcgggtggatcacctgaggtccggagttcgagaccagcctgaccaacatggagaaaccccatctctactaaaaatacaaaattagctgggcgtggtggcacatgcctgtaatctcagctactcgggaggctgaggcaggagaatggcttgaacccaggaggcggaggttgctgtgagccaagatcacgccattgcactccagccggggcaacaagagcgaaactccgtctcaaaataataataatcataatcatcatcatcataataataatttctaccaacagctggcaggaaaaaaatatgagagcatagtcatgaacttcagattccactccccttacttttggcattccattcctctgaattatagcttatatttctttattatctcagtttgatttagtctttctaaatattcacctctgtttccatccataaatatcgactgaactaccttttaatatactatctttttgtaacagagaaaatcaagtgtaggtggattattgtaagtgacactgaggaaatataaaaagaccttgacttgtccaggcgcggtggctcacgcctgtaatcccaccactttgggaggccgaggcgggtgaattacgagatcaggagatcaagaccatcctgaccaaatggtgaaatcctgtctctactgaaatacaaaacattagccgggcatggtggcaggcgcctgtagtcccagctacttgggaggctgaggctggagaatggcatgaacctgggaggcggagcttgcagtgagctgagatcatgccactgcactccagactggtgacagagtgagactccctctcaaaaaaaaaaaaaaaaaaaaaaaaaaaagaccttaacttgcttcaaacaagtcaggacccccaattccaattcttaggtctggcattcccatcagacacttaaactgtaggggcagtaaagttgcccatgtggctacagcttttgtggctgtgctgtacttgggaattttaatgttaccctctttgaattaggtccttcattgatcatgcatctcaaagtatctcagtgccacataaaaattttctttcagagtcatattttcccattatgaatgctacctactgcttatctgttgagtgtacacttttaaaccttctgtgggtggtggcccctttgccactgggtgagttagatgctgatcctggtcattatcgctgcctttccagccttttctgctcttacaccaagcacaagaattctctgctgatagtcaggatctagggctgggaaaatgggatgagttgtcctgttagacaggcccaaaaggagtattgtttaatccccagggtgtggggaagaaagatactcttgttttcttttccccaaatgtgtccatatacacccttctcctttgctggcagccaccaggcttgttgaggatctaccctcctctgcatatcatgtgcatcaagggaagccccaacccaagggaatacataatgatagtcctgagctatttcatggtgctctcgcagtcttgattgccctcttcggaattggacatggtcatattacgcaattttaggtaataaaatacaaagggcattcagctaagggaccttctgagaaaggtttttctcgtctagagaactaaacaggcatccttctccgggcactatgcgtagttctttattctacctggaacattctttctccagaaatctttgtgactaactctgtcatttccttcaagtcttattcaaatctcaacttaaaaaaaaaaaaaaccttcttaaaatttgaccacactaattagacagcaactgccccatctccctcttcccagccatctgaatccatttcccacttacctttttatgatagctcttctaggaaggcactccctcctccctgtgaatcatgtctccaggcaattgttccttgtgtagaggaacacaccaaatctgggctgctcctgtacaacaaactgaaggaggtagaattgattctgcaagaagttcaaagctaaataagaaggagtcttgtagcttctgtcttggtcttctggaatgctcactctggggaaagtgatctgccctgtactaagtctactctaaggccactgtgctgtctacatgaagaagccacaaatctaagctagccacatggggaagctgcatggaaagacaaatacgtggctagcccccagctgttggccgaagatccgcagccatcccaagtgaggagccagatgtacaagtgaaaaaactgtaacagccattccaatggagccttcagatcaattcagctttggctactatctgactgcaaacacatgaaagaacccaagcaagaaacacccacctgagcacagtcaactcacagaaccatgagcaatactgataaatggttatttttagccagtaagttctagggtgatatatagcaaaaggaacatctgtcctgttttttctggtttttcctatcatacactcattctgcaggattaacatgtgtaatatactttttttttttttttgagatggagtctcaatctgtcgcccaggctggagtgcagtggcatgatctcagctcactgcaacctccgcctgctgggttcaagtaattctcctgcctcagcctcccgagtagctgggactacaggcatccaccaccacgcccagctagtttttttttatttttagtagagacggggtttcaccatgctggccaggctggtctcgaactcctgacctcgtgatctgcccgccttggcctcccaagtgctgggattacaggcatgagccaccactcccggcctaatatacttttttaaattgtctttcactatgagaaggtgagctccatgaggccagggatattgtctgttttgttagctaatgtatccaaattacctaagaatagatcttagcgtggtaaatatttgttgaatgaacgagtgaatagatcagaatttcagtagctacgttgtgagtatgtggacagttcaccaagaatggcagaatggaaggatgggaggaacctggaataatgtcattgtgcttctggattacccagtcctggagcagctttgcctctgtgggccttgactagtcaagacattttgtgttgggtttttatgttaattccatttgcatcactataaaggaatacctgaggctgggtaatttataaggaaaagagatttcattggctcatggttctgcaggctgtacaggaagtgtggtgacagcctctgcttctggtgagggcttcagcaagcttacaatcatggtggaaggtgaaaggagaaccagcgtgtcacatggtgagagatggagtgagggggtgggaggtgccacactcttttaaacagtcagatcccacatgaactcactctgagtgagaactcacttattactgcaagaatggcactgagccattcgtgagggatccagccccatgatccagtctcccccaccgggccccacatccaacactggggattacatttcagcatgagatttgaagggaacaaacatccaacccatatcagttttctacaacctgcagcagaaagcatctcatctggcacatggtcttgcaaataattctgacttagatgcatgggactcagatatgactgaaccagaagataaatctaagtagcagacaccacagtattctcaaaaccactctttctctttctcttgttgaccgaggcttttctactgagcaaagcacctggtttataatatgttctttcattacgccttctcctaagagacctccttagtgtccctgcaatggatgtctggggagccaccaatctcttagagatgactagacatgtagccccagaaatggttacaccttgagcttttctctcagtgcagatgagatacattgcccatcccaccaatttgccacatttatctaaatttctgtgttaagctgggacctctaccactcaagctgggatgcccctcaccaccaccacactgcaaaaactaaacatttttcattagcctcctacttgcaattaagtacataaaacctgcaaaacaagtaataaaattaaggcactatttggttaatgccttttctcagaaatcacttttgcatgaagttcagttcagtattttatcagtgactacattagtctcgagaccctctacccaataggagggacaaagatgtacatgacacaggctcccttcaaagatgattaatacatgaactacatacagtattacaagggctccactagagatgtgagccccccagaaatgatattaatgtgcagaagagttagcaataaattttgcacaaggggtgacatttgagcttagactcgagcaatgagtagggttccaagaggtaaagaaaaaaatggaatggttttctaggaagaaaaccaggtctgggaagatctgatataacctgaggtagtttataagtctggaatgactgagttatcgggtatatggtggggaaggcagcagaggtgaaataagtaatatctaagcaaatgaaaaacatgtaattaggggagatgaaatataattaaattatttaccttaattcctcttttgactctttacatttgtcattcataaggaaacaatttcactaagattgttttgacctttttaccttatttggccaagtaaacaagggacagaaagtttttaatgtaaaatattcattcaacctgaaagaacattgatgattccagaccatttaaagttaaatattttagagttctcaattatttctatttggatgagtagaaccttttttcagacttcaggaatatatgtttagtttttaacagactaattgttcctgctttcatgccagcctcatgggcatcagcaggttcaaggttagtaggtaggaatctgccccctaagaatgcagcctaagagttaaggaatgcatgattacccctgtaattacttgagaggggctctgaaattctggcagggttggtgaggccaccagataacactgatcaagaatgtacacgaggttaggaattcagactgtagctgaagtggggagttcgggtaaacaggctctgaatggaaaagatcaggaattcaaatagacagttaagtcaagaaaccaacatcttagaaatgtaaacctcactttaagtcaaaggctctccaagctaagacttcataatatatttgccaaggcaagagctagtatctgcttacctgagtggtcctggagctgcggccagttgaaacaggagattgcagatggaatgtcagttagaatactttcagaggccagtaacagatacctgactttaaagttcttaagtttgtctttcccaaggttttctggtcataagaatcaccaggggcacttgattaaattattaattcacaagccccttcactggagattctgatgcaatagacttgggaatatatttttttttaacacgaactccagtggaatcaggcaagaagtgaaaaccctatcgttaataatagacacattagaaataatagagacatttgataatctagcacagttcccaaactttagtatgcatcagaatcccctgggggcttgttaaactacaggctggcaggctgctcccagcgtttctgatgcagtaggtccagcgtggagtccgagattctacatttctagtaggttgccaagttatgctgctactcctgtggtcaggaactgcactttgagaaccactaatcaaaataaactgaagtccaaagaccatcagacctagagctggttaattcaacagattagctatatcaagacttgaggtcagcttctctgggattctcttgtctttttcctcatggtcccaagatggcttcccactgcgccaagcaacatatccgcagacaacaataaccaaggcaagaaggaataaggttcaaggataactgtattgtgtgcgtgtgtgtgtgtgtgtactcatgcctgtgtgtctgtgtttggaaaagcaaacgtttcccagaagctccccaacaaatttcttcttatgtgtcaactagaactggatctcactgaacctctttaagccaatcactggctatgagaaacaagcttactgtgattggcttagaccagattttaattttttcctcagagctgtgtcctttgttgcccaatatctgaacataattgagcttctttaccaaggaacaagaagtaaatagctgttagttaggcaaatagctgggtatgtccacaaatgggttctgaaacaagtgtgattataatgaggttcagaattgaaaatattagtacaaatgctagtaaataatgtatgatattggctttcttatcaccatttgcaacagaataacagtctcatgaagaatttggcacagccattgtagaaaaagtgccttttcagagctcacagtatgcatgtactcatcttgcttttattatacctgtatatggaattgcaagctgtcccttcaggtaatgaaatttagacaagttggaacctgtataacagcaaatcaatactgaaattataggcaaagcctgtacttgtgcagactaacacataggatagaaagactttgtgatcaaaattcaacaaatcccacatttataggtatccaacatagagagaaaactatatatagtggtgtgtctttttatgtgtttgcgtttttctccttattcattcctgaaagtgtattttcttttaacagactcacaactcagctacaccccatatgcccacagtcaacacagtggaaaactgagttgtttatttgagcctcaagtcatccaaatacttcgttaaacgttgtagtaaaaggtctcccctgaattcaaggaggatgccctaagttttctgcatccttttgatagaggaaagtattaactaatgtcagactatctgttgttttattttcctttacagcactagattttgttaaggacattgataattttgaaagagaagctaagctaaggtgacaaatatatcttctgttggtcaatatctaaaattatgtattatttcttttttgactacaccttacagtggttagtttgcactttacgtaaaaaactgatgtctaccatcttccatctttgtaagcaccatccagcctaatagttgttggtttgaataatgccacaagctttgtccagaaaccaaaaacctgatttccaaagactagtctatgtagctgagcccttcattccataatcattaaactatggttaggacacagtatccagtctcccctcaaccttgtccaatcacagtctatgcagagatcatgtaactcgattaaaatctagaaccatagagacatttcccttccctggggcaaatgggaattgcacatgggggaaaatggtgtggataagcaaaaaacggaagtttccaaagtgcaacagaatattgataattttagtacatttcaacatacagtgagtgtaatgacggcattttcctactgcttccttagttgtgaagattttgttttttcttctgggttcactgccgggaaaagagcagaaaatgttttagagcctctgccagcagagggggcatttaccatttgtgcataaggtctctggcactgtgccctggggttctcttttctatatgtttctaacagtcacacacagcagtgtgactgtttacagatactttaccgtcttctctgattgaagcagggactggtttgccagcaacttttggttgtttttgtttttttgaagaccatgcaactaacagatgtttgttgttggctccatatctacattctttgaaagctggagaatcaaattgctgacattcagacaacactaattcccatatccagggagcctaatttgccgtccctgagatcctgattcctggtgttcacgggtttaaaaaccatttcagtgacacaatataagaatgggcttgggagatgcagcgctgtctccactaaagataatcacattttataaacatctgcgtcattactggtatgattcatctctaagctgtatacagctgtgtttccagtttcaattaacaatcccttaattgcatatccatctcatgttactaatttagttaatttattcataattaagagtattctgttttctaccaaggtttgtcgagctcagaacattataaagaaaaatattttaaggcagcatctccgagggattttgtttcttataatcacatcacagtaaaatgtcattcatgcgcccaaaggaagatgaattgctaagggatttttttttccagtaaaataagaagctttgggaagctgcagtgtgttgtgtttttaaaccaagttaaatgcgatgcattttgttcttttctttctccttccctgacatcctctcaaaaaaattatcattttatttgtattattgcttaagtatcacagcaaatccagtcaccagtgcaaataaaactgtcattaccctgtcaggtaatggtgtctcttaaaatctaagctataaagtctgtacattttagaggacattaagatcaagaatttttaaattgcctaagtctaagcaagtggagtacacccttgtggaaaatggaaggcagatgaaaacatgatgccaggcagtgaattcattttagtttgatcttttctacaaaaatacatatatccgtgcagcaagagtcttgcctgtgttagtacatgtgtctgtgtgtcattcaaagcagcaataacaaaaaattaagaccatttctcactttgtttattgttcaagaactcccacctatagccttgacctgtgtttgagcttaaaaaaaaaaaaagtcttataactgcccagtggtttggagattttacacaatagaaataataagccatcttttgcctcacatgaattctactaaaatcaaaactccataggatactttccaaagtaactggtgaaaggaaaagtgtggtagtataggtatgcatattatccccatcactttatttctgagctcttctattttttaaaaattttaatttgtatcttaaaagggcaaaacataagaagaggtaggagtattctaaatttcagtgacaacaaattcatttattttacaatttaaccattgcccgtcaacatttacttaaaatttcagcatgggaggttttaaacacttctagagtcccatcttaccccatttccacgatgcttttcttctccatgtgttgctgcagtttaatattgtctgcgtgttttaatatgttaaacgagttaaacatagagtaggaagttaaaactgttagcagctatatgtttcccaagattgatgaaaattcaggtaacactccaacctgttaaagatacctgcaatctggccaggtgcggtggcccatgcctataatcccagcactttgagaggccaaggcaggcagatcacctgaggccaggagttcgagaccagcttggccaacatggtgaaaccccgtctctactaaaaatacaaaaaacatttagccgggtgtggtggcatgcacccatagtcccagctactcgggaggctgaggtgggagaattgcttgaacccggagcctgggtgacagagtaagactctgtctcaaaaagaaaaagaaaaaaaaaaatatatatatatatatgtgtgtgtgtttatatatatatatatgtgtgtgtatatatacatatatatatgtgtatatatatatgtgtatatatatatatatatgtgtgtgtgtatatatatatatatatatgtgtgtgtgtgtgtatatatatatatagaaagagagagagagagagagagagagagtaagcagggaggggttgaagccagaaaagactagaaattatctaggccaaaccctttaatttatagattaggaaatagtttctggttgacttagctgagacgttctcatttgttaaaagcaagatcagaaatcagacacaattcaacgctcttcactacaccttgtttttctctttgtggaaaacaagacgtatcctgttcaaaaatttatgctgtttatctgaaagcccaaaatgcctgtttacatcatattttccattttgcaatagcagctcattttggggattattttctgatgaaatctctaggtttagttgtacttgaatatctttttatctgtacacactggaatatgcatataataattgatagaaatgtggattttaaaagtagagatgatcattattattttatgatcctttaagttaataaaattcacctagaataaaataaacaagtttaactaaagttctcgcattttcccagaaatcgtagactagaaactagtcttatttgcttattttattccaaagcttattttacctctattattttgtggttctataaaatatttctgtgtattcctccaaagaacctcttggaaaagaaagtaaacatcacatctgaaaaatagctgggcattttttcattatctctgcaaggggaggggacgtgaaaggcaaccccatatagaaactcaactccctgctttttacaatgaatgaagtttttccactgcactgtcagaatggtaattcttgctaactactcacctatttcacaacattaacagagttccaggattcatgctttaatattgcataatggtccatgttttgaacatgaggagtggcagcggagattacactttgattccttggatttcatgtggcactggatgggagcaaggcactgattttaagttgagataaaaaggagaagtcagtcaatgcctgcagccagacaggactcttgtaatagctagggagtatgcctcatttggatatgcatgactgccgggcaaggacactgccatgaatcgctaatggcagcagttgtatgacataagagagatgtgtatcagcaactcacaagttgactttgttacatgttatgaacacattcctgtgggcactcattcatagaagtgagaaatgtggacaccacagtgtcccaggcctttgttaccttatggcctgggaatatcttgctttgctggaacatgaagccacgtctggttataagaagaagtttgatctgggagcaaaattgcctgttcacgcatgtctttctcacttctttaaaactaacttgctataagggtgattaaaaaaaacagatgtcaggtgagagttttgctttgcatcaacttcctacttgtagaggtaataacataaaccttgcctggcaatcattatttgtcatccagctgagggtgtttactcttgagaaagaagtaatggacaaaattgacttggattctggttctatgtttcccattaattgactctggacatatacatgcaatttaatccatcttactaaaaacatgaccaactcacaggatgtaaattctattctatagaaagggctttccctcagtagttagtcaagggacggttcctaactcctgtctttattgagcttattttccaaaataaatgtattattttctactttgttcacagagcaaggcagcataaagaaattaagcaacaaaacaatagtgtatttttacccaactttctagaaaacacccatttttcttaagttttgatatttttttgccaacaggcagtcaaaaagaagataaataaaactgggttaagttggtaatgacacaataaataaatgagatgaagaaagaggcaataaatatgagtggataccaacaagaaacatgttcaagccctgaaaaaataatgagaaaaggtagaactattaataatacatcccgctctcgtatcacaccttgctccccagatacatcctatctgtcctggcaccatgttgatgctgttgttctgtaagctatgccaatgaacatgttggatgacctactccagctctacctcaagatttccaaataagaaaaggacccagggatctccttgctgaggtctttatccatttactcaggtcacaagtactaattaagcagctcttatgtgcaaaatgttattgcttcaggtcagtttttcctatactgctgttctataagagaggaagaaggtccctgccctcagaaagccctagaatacagatctagagatgggttcaacatctttgttatgcaattatttcattccaattgtaatgagtacttagaaaggacaaaagcagagtgctgagagagtataacagagggacttgacctggtgtagtaggcctggaaagtttcctggggaagtggtattttagacaaacaacacacacatacacccatgaatgtatacgtgtggagaatgtattctaagtaactatgatgaatgtatttcttactgtaggtcatggtcaaagtttgaaaactattgttctaactagtattataattccagggatagtagaggtcatgtgacctgtttagcacatgcctgccttaacagtatctagtaggccaggcaatgtggctcacacctgtaatcccagcactttgggaggccaaggcaggtggatcacttgaggccaggagtctgagaccagcctggccaccacggtgaaaccgtgtctctgctaaaaatacaaaaattagccaggtgtggtggtggtgcctgtagtcccatctactggggaggctgaggcaggagaattgcttgaacccgggaggcggaagttgccgtgagctgagatcatgccactgcactccggcctgggccacagagtgagactctctggaaaaaaacaaaaaacaaaaaaaaagaatgtctagtaaataagtcagtgccaagcaactacctgataactgttaccaccttagtcatcaccgaaggcagaaggtcttgcattcattggaggagagttaccaatctaagacatttgcatgaaaatgtgcacagagccctcacctgataatcaaagcatgttccaacacttctctttggataaaataagagttacatctcaatgaaatcacttgtggatcaagttctcatcctttcgtaaataaagagaggggcagcaagaaatggaagtgagcacatataagtgtgggaacctgtactttcctaacctataaagcattggatgtagtttttgctattggtgcgcatggagtcatgtggccttggagcagttaggtaccttccctgatgataggggagaaggcaaagaaattgatgatacatctctctcattgtcattccctagtatattacacttaaatctaactgccctattttgtgattgccttactgctgtggcttgaatatttgtgtctccccaaaattcatatgtggaaacctaattccatatatgatggtattaggaggtaggccccttgggaggtgattagatcatgagggcagagcccacatgaatgagattagaacccttataaaagagacccagagagctgctttgccctttttgccatgagaacacaagaaggtgctatctatgaacaagaaagcaggccttcaccaaacactgaatctgccagcgccttgatatcagacttcctagccttcagaattgtgagaaaaaaactttggttgtctataagccacccagtttatgatattttgttatagcattccaacggactaaaacattcattttccagaaaatctactccatttataagccagcattcttttttttttttttttaattttctacagatctctgcagaaacatgcagagtaataatagggccaggcacggtggctcacgcctgtaatcccagcactttgggaggccacagtgggtggatcacctgaggtcaggagttcgagaccagcctggccaacatggtggaaccccgtctctactaaaaatacaaaaaattagccgggcatggtggtgggtacctataatcctagctactcaggaggctgaggcaggagaatcacttgaactcaggaggcagaggttgcagtgagccaagatcccaccattgcactctagcctggacaagaatagtgaaactgtctccaaaaaaaaaaaaaagaagtgataatatatttgctgtatatattagttatagatagttatattgcagtactatcagaagctatgccacatattatttacgtatttcttaagatatagaaaacatccctcccctgcagtcattagtacttttgcattcaaacttcaaatgaaacaggactttagaaattataggcttggtgccatcctggccaacatggtgaaactcgtctctactaaaaatacaaaaattagctgggcgtggtggtgcacacccgtagtcccagctactcgggaggctgaggcaggagaatcacttgaacctgggaggaggaggttgcagtgagccgagatcgcgccactgcactccagcctggcgacagagcgagactccgtctcaaaaaaaaaagaaaaaaaagaaaaaaagaaaagaaaaaagaaattataggcttggtgatttctcaggcattaactcaagaaagcagcctttataccgattacctacattcacccagcacttaccccattaatttctaatgttgcttggaacaaatgaacattcctggaatgcaagctaaatgaaagagccccgaagaagaacagggcatttcctggttcctcatattgacaaatttaaaagcctgtgctataatatgggctcctgtttcctttcaagtttgtctttgaataagtggacagagtagctgaaagcagagtatttaaagctttgaaacgaccactttatttcagtctctgttcttgctgggaccactcttataaatgaggagattagaaaatcacctagaactatttaatcgttgtgcagaagaccctcttaccccaaatatttacttaccgctcattttattggcacactgcctcaaattccacctgctgtgaactgacctaagtgaatttaggtcacgtgcaactattaggttctttttgggaaataatggagaaccacagatgtgtttgaggtggatgaggaatggctacctcaagccgcagcttcatgcttcatgctgaagtcctccacaagtgcaatcatgtcgttaaccaacatttgttagaaggcaggcagaagtcagcttacagcctgttctacaatttttatgaagtgtaggattttaggcttaaattgacaccattgcaaatacagtattctcttacctttagatttggcatcaggtcacaagaattcttcctaagccaatggttggatacaaggccattggagaccagacgtaaaattaaaagcccaagcaacaggttttgctggattcttatatcctgtttatgcaatgttaggggatgtcattaaaatattttagttaatccatgtatcttgattgtcttaaattttactaatgagatcctatagggatattcattgcaatccactatttccctcagcaaaaacacatttgcgatatctattacatgcattacaaaatcctccaaggttcacagagatatatagtagtagcagtctctgggttttggcctttttcataagatgaaggctgtgctgtcctagaatatgaattcctaattaaaataaccatttgcctcaagcctctagagttgaaggttgcactaactgcacatataaaatatccaactatctatgttgagatatttaaaattaattacagatattgtaacaccattatttaacttaaattccattacaggtcctttgagtatgcaaaatatttctttgagatgtggtaacccctttaactgatcaggaaataaacctttattatcaagttgttatcccaccttgacaggcctaaagcgcagaccacatatcagaatcccctgggcagcttataaagctcctcatgcccaggctgcatctcagaccaattcaatctctgggggtgggctccaagcatcagcatttgttgaaaatccccaggattacaaagtgcggtgaagtttgcaaacccttgtaataagagaatgggaggagggatggctgtttgccaagcagaaccaggaatgaggaaggatattggtaaacaaaatttatccataattgacttttcatgaatcacagtcctactgagacccagccttgtctcatgagactttggctacgatgatgagtgagaaaaggactcctcctaatttaccagactcttgattagaagcaaatgaaattttggaaaagagacaagtcactttcaaaagaccccagcctgtacctgaccctacctctggactccatagtaatggcaggtagtggtcattcctggagtaactctgtatttcttaaaggaacatttgcataatgaacctacagcaatctggaagacgactggggtaaatagagaatttgttgattttagatggctgaatactatccgtgcagagcaattaaaaggacaactgtcagaatcaagtaagagaaaggaaataagagaagtctcatgttagtagaccttgtttgatcaatgtgttttcatcttgtatatgattaataaaataagtttgggagttaggatcaacctttgtttactcactggagaataacttgcatatagaatgaagctgggattgtccaggctggtttttttccatttggaagtttggatacaatacaaggaagcctgaattccaaactgtttctcttaaagagtgcctttctgagccgctattaaggaatgcttattgtttcgaaaatggtagcacagaagtgttataactagagtacaccttgtgcctgcaattaattacccagtgtcttcaaaaattcttgtcttttgctggtagaaaacctttgaaactatagttgtctgtggtattcactgcagcaccttagatataaagagagaaatttattttcagaggaatcttgagacagtttgtgtgtgtgtgtgcatgcctgcttacacatctattggttttccccaaggattgtagaaatcccattaaaattccagcttcttaaggagctactgaaactccagtttttcatattttcttttataatatttggatgcgtttaggtaaacttgcagcattttaattatgtctgtatcagatgagcggaagaaatgtaaaagggtttggggagagatttaattttagatagcggcgtaattaatagcatttggaaaaactagtggaactttaattaaatgtctctacattaatttagtcatttaattgaacatgtagtgggatagtccttacaatttttcacccttactctttgaggaaaaatgatttttgaataacaaagcatcagtatgactactttttattatttagctgtatgttcactacttggcactttgtttaatttttccccccatatgtttcgagctttttaaaacattaatttggcttgtcgcttttatcttaaaaactataaatctgggggccgggtgcagtggctcatgcctgtaatcccagcactttgggaggccgaggtgggtagatcatttgatgtcaggagttcaagaccagcctgaccaacatgacgaaaccctgtctctactgaatacaaaaaaaactagccgggtgtggtggtgcatgcctgtaatcccagctacttgggaggctgaggcaggagaattgctggaacccagggggctaaggttgcagtgagcagatattgcaccactgcactccagcctgggcaacagagtgaaactccatctcaaaaaataataataaaataaagaaataaagaaaactataaatctgggagaaaccgtatttggaaacattgagcaactgtttcttttcctttattttagactttaatattcactagagtcatgttgtaaagttttcaccttaatattgtaggctttttttttttttttactttgccaacttaactggcttttttaaagtggtgttatgctgcagcagtgtatctgaatttcagcagtgccttttacgtggctgctcacaatcttattaaactacatgaattatacatggagagaaatataatttggtaaatttggtgatgtttcaataaccatgcccaaggaggaatgttgtgttaaactgtcaatttgagaagtgttttgtggtgctaaccacagagtgaattcagttctacttcatttcacaaccctccataaatagtgccccctaaaagtggtgcctccttgcctgtactttgacccagatttttgtcatttttctagataagcatatacattgtgcacttattaatttttcaaatgacacaaaggtgagaatgggagtcaacacactgaaagatcaaaatcaagactcaaaataagattataacagactgggatactgtaccaaaataaaaaaattaaaataaaatttaacaagaacaagcaagatgtcctgcctttaagatttttaaagtcttttgtacaaatataggctgaggaacatctgactttgtggcgctttatatgaaaaacaaattgggattttaaataaccacaaggactgtattaatctccagtatgatctggtgtggcttactgtacgaggcaatacagtattagattgcattaatgaaattcacaaatgttccattaatctcttcactagttaaaccacatctgcagtcatattgacttatgagcatcacgtatgatgagaacactgaaaaatcataatacattgacagcagggcaaccaagattgtgaaaggtatagcgatggttatatgacaaatatttgaaagaatctagaatgttcagtaagaagataacatgaaaatacaggacagcttcttcatgcatctggggagggtgggtaaaggacacagcacacttaattaagtaagattgtagaagagaactatgggcaagtgttacagtggagcttactctgagtaaggaaaatgtaaacgttagagttgttattaagtggcatgggctgcttcacaaatttccatcattttttaatctgattcatctgctaataggacaaactgtaacaatagcttaaacaatagagaaatgtaggtctctctcatgtacaagcccagaactaggtagatcaggcctccttccgctattctgcttcactaagtccgaagtcctcctttaccttgtcctgccatggtggcctcaattctcgttgtcaccacatggtccaatatgtctgcttcagctccagccaacacatctgagttccagcccccagcaacatggaagaaggaaggaggcacagagagggcgtgtgccagcagtgttgtgagaaaatctttcagaaactgtcatgaaatgtatcccctgatagttccttcaccagaactttgtcccatgattatatttacatctatgtgaggctaagaaatatattctttccttcaggcatctacatacccaactgaaaattatgagttctattgccacaagaaaaaatggaaaatatatggggacaatcaacagtacttgcacaaagatgttttacagagaattactcttttacctgggaattttacaagataaactttaagatcctatcaactctctctctctctttttttttttttttttttttgagacaagagtctcgctctgtcacccaggctggaatgtagtggtgcgatctcggctcactgtaacctccacctcccgggttcaagtgattcttctgcctcagcctcccgagtagctgggactgcaggcgcccgccaccatgcctggctaatttttgtatttttagtagagacggggtttcaccgtgttggccaggctggtctcgaactcctgacctcaggtgactcgcccgcctcgacctccctaagtgctgggattgggattacaggcatgagccaccacgcccagccagatcatctctggaggcagggggatcacttgaggtcaggagtttgaggccagtccggccaacatgacgaaaccctgtctctactaaaagtacaaaaattagctgggtgtggtggcaggcaactgtagtcccagctactcgggaggctgaggcaggagaatagcttgaacccaggaggccaaggttacagtgagccgagatcgtgccactgcactccagcctgggtgacagtgagactctaactcaaaaaacaaacaaaaagagtctatgatcctataatttatagacaacatacaacctcctttctctacaaagagaattggttctcaagggctgtttggaaattcatttccttttaagtccaaaatgacatacaaaagtgaccaatatatacaatgtacacccttctacaataagttctcttttgttgccgtagtaatcgcatgtcttttcttaaaggaacacttttttgactcttttgtacttttgaacatagcggtgttaataataatatttataaaacattatgaaaatatgcacacaaaacacaacacaggctaagaaaacctaatggtggcctaaagtaagttctgatgtcctctgttggtggtattcttcattgccatgcttctgctgtgcctgggacctttattgctacctatgggaagttgtaagtagagaagtttctttactacagggatgtgaacaatcattgtaagtaaggaataatgaattcacataagttcacagagcatgtttttctgccctggtaatactgcatttctcactttgcatttaaagtacctacgcccttacacagaaaaagttatcggggttgggtgcagtggctcacgcctgtaatcccaacactttgggaggccgaagcagggggatcacttgaggtcaggagttcgagaccagcctgggcaacatggtgacaccctgtctctactgaaaaaaaaaaaaaaaaaaaaaaacacacacacagaaaaattagccaggtatggcggtacatgcctgtagtcccagctacttgggaggctgatgtggaagaatcgcttgaacctgagaggtggaggttgcagtgagccgagatcgcaccacttcactccagcctgagtgacagagtgagattccatctcataaatatataaatatatatatataattatcgattgattaatattattatatggtccccattactctaaactctcaaaatgtaatgtaggtcaaaatcagaaaaaggccatactgtctactccttcctctgtttcattccaactataagagaaagggagagggcaaaacaaagatgacaggaggccaaattgtacatagaattcatggaaattcttacccaacatgtaaaattatgatagtataaggaaaagtatactgcaaaaattaaacttctacattgtgaaatggagaacatttttacatctagctctattgcttctccctgtggagctgttctaagcacaaagttcccattacataatgaacaactccttaaatactgtgcaactatttctcactagaagcacgatgcagcaaactctgtttctcagtaaccatttatatcatacctagtggtaccgagttctataataaaagggtgatatgtgcatattttgtggtcatagagtgcaaagttgacatctacagtttaaagcattgcattgcatgaataaggtcaaaatttaaatacttttctatgatcatgttctttacattaaaggttaaagatgcatgccgctttaaaaatggtttaagggccggacacggtgactcacgtctataatcctggcactttgggaggctgaggtgggcagatcacccgaggtcagacgttcaagaccagcctggccaacatggcaaaaccctgtctctactaaaaaatacaaaaattagtcaggcatggtggcgggcgcctgtaatcccagctactcgggaggctgaggcaggacaatctctggaacccggaaggcagaggttgcagtgagcagagatcgtgtcactgccctccagcctgggcgatagagcaagactctatctatctcaaaaaaataaatgaataaaataaaataaaaatggtttaagaacttcaaaccatctggcaccagaaaacacctaaattgaattaaaaatctggaaatttaatttcacaacttgtcctttttcaagcctaccctaagttttgtttacttaatggggagaatctgttttatttgttcctatgtagaagactgctgattttatcatgattgtattagggcccaaggatatttaaaatatttcagtagctattacttatactttatatctgcattgcactttagagttgactgagcattttcaaagtattatcttaccaaattgccacaatagtcttgagaggctagtaaatcatgggagaagcccccatttccccactggaaagcagagaaaacccccattgtagtaaaggaggggttccctccagagctcttgtggttgtgttgaggaggaagtattaatgctgctgggcatgacttacaagaaataagtcaattcacttaagcaaaagtgctatgatcctgtataccatgtgagcagctctaggatggggtcacccagcattttggagcagacattagaacatctggagggagtaaacgcaaagaaaatgggctagatacctttccttggatgggaaaggataacattaagataccaagatcaaatgttcaaagagcacatatacaccagagaatactatgcagccataaaaaatgatgaattcatgtcctttgtagggacatggatgaagctggaaaccatcattctcagcaaactatcacaaggaccaaaaaccaaacaccccatgttctcactcataggtgggaattgaacaatgagaacacatggacaaaggaaggggaacatcacacaccggggaatgttttggggttgggggagtggggagggatagcattaggagatatacgtaacgctaaatgatgagttaatgggtgcagcacaccagcatggcacatgtatacatatgtaacaaacctgcacgttgtgcacatgtaccctaaaactttaagtataataataataaaattttttgtaaaagcattgtataataaaagtagtaagataaaccagtaaaaacaaaacaaaacaaaacaaaacaaaaaaaagttcaaagaggccgggtgcagtggctcacgcctgtaatcccagcactttgggaggccgaggcaggcggatcacttgaagtcaggacttcgagaccagcctggccaacacggtgaaacctcgtttccactaaaaatacaaaaattagctggatatgatggtgcgtacctgtaatcccagctacactgaggcatgagaatcacttaaacctgggaggcagaggttgcagtgagctgagattgcaccactgcactctaatgtgggcaacaaagcaagactctgtctcaaattaaaaaaaaaaaaagtttaaagaaaaataagttatttctccatgcttcaggagatatgtttcgcaggagaaagaggcttaatagagaaaacagatccctacaaacatttgtggtttttaaaactgccccattggttactaagtggataacatgagcgtgatgccagattcagtactctagtgagccatgcagctttgctgtgctctgcacctgatgagtgtggcctcacttcttataaatgcctgtcattgctaacaggggtccttgctgaaacaacagggctggactaatgctctagttcccttcctggaaaacctatcccaaagctgagatcctcatgatgccttctctcatatatgaatgattgcaggttacgctatcatcattaaatcgaaacattttagaccactttgcgtttgtttgtttgtttgtctcattatgtccagttttatcctgtttcataatttaataaatttttattgggtctgtcttctggttaaatgttgtgtgtataaaaaataaagtcaagagagagaacaggagttatggaactaatgacaaatccatccttcagctaaataaaattatactatggatgatttgagctgtacgttgagtgataatttttaaaaataagatagatcgggtgcggtggctcatgcctaaaatcccagcactttgagaggccgaggcggatggatcacgaggtcaggagttcgagaccatcctggctaacatggtgaaaccccatctctacttaaaaaaaaaaaaatacaaaaaattagccaggcgtggtggtgggtgcctgtagtcccagctactcgggaggctgaggcaggagaatggcgtgaacccgggaggtgaagctcgcagtgagccaagattgcaccactgcactccagcctgggcaacagagccagactctgtctcaaaaaaaaaaagaaaaaaaaaaagggccaagcatgctggctcacacctgtaatcccagcactttgagaggccgaggtgggtggatcacctgaggtcaggaattcgagaccagcctggccaacatagtgaaaccctgtctctactaaaaatacaaaaaattagctggacgtggtgacaggcacctgtaatcacagctactacggaggctgaggcaggagaattgcttgaacccaggaggcagaggttgcagtgagccgagattgtgccattgcactccagcctgggcaacaagaacgaaactctgtctcaaataaaatgaaataaaataataataaaaaataagataaagtatcacaagtaagatgtagttgaaacttcatgcatttttctatgatgcctatgatattcaaaagataactgaatttcatgagcagagttcaagaacttctgagtatacttttcattgatgacttaatgtaatggatttctatgatgatggcactatattcttttggtgtttatggtattaataaaaaattgtggtaaagcttgtggaaatgaacatgccttggattagggtgccttaaatgtgcctttgtaaatgcagctaggagactccaagtcacccttctagtctaactgctactcctttcttttacaaactacatgccaactaaactgaccttgatctgtttatgaaaaggcggtataggaacaggggctctgcaattggacagatccaattctaatcaatccactccattgatagatatataaccttgagtccttcctgtgcctcagtttcctcatctgtaaaatggaattaaaaaccaacttcgtgaggcttttggagaatgaaaatgacataactcaaagattattgggtatcagaaacaataatgttatctatcactgtctttactgttattattattattgtcattattattattttctctacctggaacaccaattccacaaactcttaatgtcaagaccatgctgtatcatggagccttccctgattcctccatatgaaaataattaattctcatattaataatattacttttctagttgtattttctttttttagcttttattttaggtttgacggtacatgtgaaggtttgttacataggtaaacacatgtcatggaggtttgttgtacacattattttatcacccagatattaagcccagtactcaatagttatcttttctgcctactcgtattttcattatccccaagtatactatacatatcttaaaattaggatccatgttgaaaaaacattgatatttcctatggcttctaacacagtacattgcacttagatattcagcaactctgtattgaatgtatgggtacaatctgctcttagtttctaatttggtattaatatgttcaagcctcaagagctcatgtaaatgatggtttgactatattgcccatcttttgttaagttgaaaagctgaaattcatgcactgtttgttagtgtagtaatttgtgacaacgtctagctattaagtcttttctaggtataaaacctttatatctgtcattgttcccctcttgtgtttttgctttaatatcgttgaaagcatctattattggaactttcacttctgaatagtacttttgagaacctgtatagaatttcagaggccttagaaaattgtcatagattgcttttagtatatggtttaccactgtggtctcttaacttttcaaaaagtatttccaaagggcacttacatccataagtggaaattgatttacatctattattgctgattgttcactattctgaacttcggctaaacaggtgatttaggcagaatttttttaaatattagattttttcctactttctaaatattttgtagctctttcttattaatttgagtcaacttatgctcgcttttttttgtcaattatagatggttgtcaggggtttggcaaatgtcatatgaaggtaattctttaaaagttgggatttttgaactgtttatttctactacttttgattttgctggaaattatcattctattaaagggacaaaagggtgctcagaaatatgcattgaaaaatttcttacagatttatcaaccattgccctcaggcactgatattcagccagtatgttccaatacatccatgtctttccattttaaaccttttaattctgttctaatttttcattgcctgtgcctgattgttctgtatccatctgatacgaatggttaagtacaacattttaaatatcactcttgcctatacatattatttttcttgtcagatgatataattgtagtcattacatgtttcttaagcacaactgaaatcttaatttaaatcaataagtcttgtttctgtggccattgtttcccagaactctccggatttctaagcatggtggttattcttccaggaatagtgccgagagtcttcagcagcatgcatttctctctaattgacattatttcacactctccattttccttactattgaaaactgtatttcattggtattttgccaaggatcctgctctgtttcataataatgttctgttcgcactctctgcactgacaaatacctattccatgcatcaattgcataaatggcaatttgaaagcatttaaccacagctggatatttttcattgattcttttcatctgaagatcattcattaggcttctccctcctgtttcttctcacatccatacctcctttcctcctatgtacatagtgtcttttgcattttctgtatttaagtgtaaattgctgactacagttatgcttttacctcattccatggtcataatgaaatcacaaatttaaaaatgtactactttttaaacctgttttctgacttgtccatctaaatgcaattttataattcttcgacattcagcctcctggtgaatgatttctgcaatctctccaagacatctgtgcagtgttatggattatattgattgcattttgtccatgttcaaatttgcagaatgtaacctacagaatatatattgactaataaagaaatgcatccacatggtggatggttgtaaagagaaaatatatattggtgtgcagcaggcgcccacacaaatgaaatctagaaaacagcagcttgccatgtcagagttgcaaatgaaggctgtggctacaaaacacagaaagtctggagtgtatgaaaggtttttcttccaaattcattcacacataaaaatgaaaaaattgaaaaatcatatatgtgcaccttaatttttatatcgcattggtgtttgggcatacgaccctgagattttcataccctcgatttttttaatataaccacctgagcgtttcttcccatggggttactttagaagatggggggtgtacacactacgtatgtatgtcaataaagaaatgaaggaataaaggaggaaagaagtgaagaaggctgggggtaggaagggagggagaaattcagtgattcattacttattcatcatcctaaactggcatataaaataatatgtttaaatcagtctaaaattttcattgtataatctctgaaataactagtccccactccctaaactgtttggtgtaaatatttatctatgtctaatcatttctatgcaaaatagccttatatatattttcattttcataagatcatctaagaatcaaaggaaaagctattttaggcaatgaacataggcagtgatttcaaaatagaatttgagaaatgcaaggatagatggaatcacaaaagatgatctcattcatggtgttttaaaccctacaaatagatttctgtttagttgacctcatttcaatagcttctcatttttttcagaagtgtatttgatgtgtatatttctaataaacttatttttctttttgtacccagtattaaggagcacagcatttatatccactgaacaaaggataactgaaaggaaactccttgatatccaacttggagtatttgtttctcgaatgaatatgagtttatataagtagtttttttcacatacataaaattagaatttgtttgtattattgatattatttcagaacagcggatttaacgtcatagatgatctagatgtgtcctttccttagaaatctttaaaatgaatcacatagtctagaaacagatccagatactacatgctctcatcagaaaggactttcttctcttcgtgtcaagttcagtgttggcaccgtatagacaaagcgtgttaaaatagcagggttcttgttctctgacacattacaagagaggcaagattataaaactgctatgtgtctcattataattcccattagtttcatttgcttcaaaacattcacttctgtgctttttgcaaaagctttcaaacttattttttgatgattctaaaagtaattcttctatgtcttttcctagtgatactagcattagttttcttttccaattgtactaggaggcatgagagattatcgatgccctattttcttgtctaaataggcaacccaaataatcatagtgacctgttcatttatattatctttatttcttgcctcatacttcttcatatttcttcatttcccatgtttccttattctttggagccagaaacgatcacgttaatcactctttccattagttttctcctatacattttctgatctttctctgagccagttaagagtcattcagccatttgataatggacactagtttactttgaccttgcaaacacaaataccctgtttgatctttatttgctgagagcagtaagacagaagaattacaataaactttttagcacccttctgttcaattctttttcagaaatcgttccctcaaaaagcctattctaggctctttcttttggcagtttcctagaattttcctttgcttttcaccaactggaacattatcactagaagtaaactaagggaccatctaattcaacaccctcgttttgtactttaggatactgaagccaagagaagctaatttttttgcctgccataacacaactagttagtgaagcagccaaaactataagggatcttgccaccataagctttatcggcccatccgtttatctcctcaaagcagccctatacctgatttccttatttctgttctctaagtaagccaagctcagaccttagagtgaccttcccctaatccaccctgcctgacatccaataaactgacaaatccagttgattatgaagctacagtgtttttcaaaccataccataattgtctaggctgttgccatgctctacacaccagttttcttattccagtccctccctgccccagtcccagttcactctactcagcctctctactgcaatggataaaatcacagtttccagattcacaaagctcacagctctgccactttctagccttgtatttgtgtttcagttgctgctgaaactctctaagcctattttccatctataaaatggaaaccaacccagaggctcgttgtattacagagatattgcatgaaaagcatttagcgcagtgtctggcccataagaagtcctcagtaaatagtagtcttggggaagcagtagggtgttgtagtaagagagcagagcaggggacagcaaactacaggtctcagtacaaattcaacatggggcctgggttttttttaatagcaggggagctaaaaacagtttacttgttttaataagttgtacgaaacccaaagaagaatatgtaacggagatttatgtgttcctcaaagccagaaatatttactttctggccctttacagagaactttcattaattcctgttgacagctgtcagggtatgaatcctctctaccacttagaaactgtgtaaccttgggcaaatgttttaacctctccaaggtttggtttccctgactgtgaatagtacctatgttacagggttgttatgagaattaaatgagatcatttatatcaggtgcttagctcactagctgaaataggatttaataaatgttagctgacatggttacgtctactcattgttgcagataaatagcctctaagtgcagctttaatagtgattgtttcttaaaatttttgaacaaagtttttctatttcttatccaattaaataaatattccacattctggcattcaatatttctaacgacatcaagcaactctaaaatcattgaatgttttaaagcaacaggaaaccttagaaataactcatctaaactcatatcatagatatggaaactaagggccaataaaaccaaggcttctaggacctgaaatcagatcctctctttttaggtagtgtgatcttcatcgtgcttctgccatgcaatctcagaatttaaagggatttaagaatcattcattttcttcctaaggcaggattcgaccctataaaatccctgtcagtttggtcattcaaacccagtttgagtacagtcattgatgataaatcacccttttcccagggagcagttctggttgtttcaaagtctttataataaatgaaaattggctttcctgaaatctctatatattgatctattcctgcccactggagccaaagagaaacgtcacttctctacatctgtaaaatactcgttgtcaattttcgtatcttctctaagcatcctcgtttcaagctgatgtgaactagttgggtttttgattgttttcattgtcctgctaagtcgaaaagctaagaaaagcttggctctttcatcactgttatatatcccactgtgtaacagaacttgagttcagggtatacactctaaataactgcttttgtaaaagtattcaattatattgatttttttcgttccctctgttgttcctcataattaccctcagtcaagactttcatcttcgtctttatcttcctctgcaagaattaacagtggtcccttttgtgaacttcaaatatctgagactggtctcagttaatttaggaagtttattttgccaaggttgagaatatgcacccatgaaacagcctcaggaggttctaacgacatgtgcccaaggtgtttggggcacagcttggttttatatatatttagggagacatgagacatcaaccaatatatgtaagatgtacatttgttccatccagaagggtgggacaacttgaagcaaggaggggcttccaggtcacaggtaggtgagagataaatggttgcattcttttgagtatctgattcgcctttccaaaggaggcaatcagataagcatctatctcagtgagcagagggatgactttgaatagaatgggagacaggtttgccctaagcagttcccagcttgacttttccctttagtttggtgattttgaggccccaagatttattttcctttcacactttcaatataagctatccagaactgatgataatattccagatatggcccaaccaatggaaatgattgtgtttcctacataccatatcacaatcaaacctgttttgcaccttgcatttactttctttattaatgatgtcattgcaatttagaaaatttggggccacatttacttcttcctctctattatcttcagtttttatttggtcactaaattctgtttgctgactcttatatctaaaaataaaaacactcaaatccagctattcctctctaactactctgcccttccctcagtcctttctcagtgactattaatgatttggccttctaatgattagcctccctgtccccagacttttatccatctttatcactatggctagttatcttgctaaacaacagatctaatcctagtaccccattatattaaaaaaatcttctatagctacagctttctctccctccaggtcagtatccatagcctgtcaagatgtggctttgataaaggacagaaggcagggaaattctgggcagaagagggcaggtccccattgaggacccaccctcaagccaaaaagcctggaaccatggcccaaagtgagaacttacatccctgttttccctcttgaagggtgccttttccaaaaccatccattaccccccacccaccccccaacctgtgcctataaaaaccccagagctcagctggcagaaggaggagaagcagatggatgtcagaaactacagttggacatcaaagagaagcggcttgactttagagggacagtttgacagcatagctttggagaggagtccagctgtggatggtcagactccaggggaagattaccttcccactccatccccttttcagctccccttcccactgagagccactttcattggcaataaaatcccccatatttaccatcttcaatttgttcatgtgacctcattcctcctggatgctggacaagaacttgggtgccatgcgtgtgggtgaaaaaggctgtcacactgaccctccactgagctgttaacacttaagccatctgtgaatggcaaagctaaaagggcgctgtaacacttcctcatgggcaccctcccctagaggctgctgcagggcccgtacggtgttcactcttgccagcactcaaaaatgctggccccagctgctgcacctgctcacctgtgctcccccttccatgaggggtggaccagcgagtgagtggagtttgctcccctccagttcccacccacgaagggatcagggaaatatcctccttcagctccagtgaggcacagtggtatacacctatagtcccaactactgaagaggctgaggtgggaggatctcttgaacccagaagtttgaggctgtaggcactgtggttgtacctgtgaatagccactgccctccagccttggcaacatagcaagatctcatctctaaaaaagaaaaaatatatatgatgtggctccaattcactgatctagcctcttaactgaattccttcctcctggctgggcacagtggcttatgcctgtaatcctagcactttgagaggccaagacaggagaattgcttgagcccaggagttcaagaccagcctgggaaacatagtgagacttcatatctacaacacattttttcaaaaagaattttttcctccctgctccccaccctacccccttgcaaccttatttactcttcggcctctggccctctcgctatgtctttctcagcttcatgcctttgaaaatactctttctatgcctggaaagcccttataaacctggaaattcctattcttattcaactctgagccagtccattttagtggcttagttcagaggctctagatttaaattgcaattctgtcagattctgtctgctttgccaacctcaatcaagttatgtactatgcctcagtttcctcatcagtagaatgaaaataatacagtagtgcttttttcatagggttgtagtgaggattaaatgagatgaagcgtataatcctcatgtacataacacagtacatactatatgtgttgcacatagtaagtgctcagttctttttctttgcattattcttagcacataagtcaagttacatttgctctcccttacgcaaggtcaattgttcttttttatgtgtttacccgttactttgttcatgcatttgttataaccactgccatcataaagcaacttgctatctttgttcataaaacaaatcccagattcactgagctcaaagtgagagaaggaaactttgcattatgtgcagttcctatgcttttctccaaatttcacatctccgttggggatctctcactagttatccttgccatacccccacaccagccttacaattttgcattatgtttcctacatcatgattctaaacggtcctcctgttcgctttctctccatcccatatcgttgcagatagctatttcctctttttaagacagaaacacatttgcattttgcctaagctacatttgtaaattttacagtattttcgaaagacacaatggaatctaggaaagatgcaacagataaagagattaactggccaatttttgagagcaccatccgtaaagtccacgaacaagtgaggcttccttgtcggagaaagcaattcagtcaccataaatgatcattcaagcctgatctcattccctcttgaaactggaaattgaaagcttgttcctctgacagttgtgttgtcagtggatatgcccagtgtgcaaaggactggacaaagggcaaaagtacacatatcccatctggaattctgagtcatccctgagacatcattttggatttgtctactgagatgaaattaaaacatgagtaatcaagcccacacttcttccccctcaaactcatctctttggtatcatcaagaaaatcaaatgctaatagccattgacctcctaattctagtgctcttagctatgataaaacagtcattaacttaatctaaatgttgcaaataaaggagccccatcaaagctgaagccccaaaattatacaaatgagttaactgggaaggcatgggggaaacaacagttttcataagacacactctaaatctagtttattctcttaggaagacttttctcatcaatagagagccacataaagatgccttacctgcctttcacggggactatatcaattggctgtactgtcactcactccaaaactctcaaaatgcctaacacagattcttgattttattgattgcattagatgttacgttttctaaattttcagcaccctggaggtcacctcaggaaatcatgcagtttttgaatgattttccttagaaatacacgtgtagctatacatatgcccatgcgttatttaatcagttagtgaaaggaggaaaacagcatttctattattgacctttctcaatctctgaggagactgtatgtcttgcctacagtccaggattgaaagcaaaagaaaaaggcactgacaaaatagcattttattttaatagcacattatggagagacaaaaaaaaaaaaaaaaaaaaaaaaaccctgggatttcctttgtctaagtagaattgacgtatgggtgagatcagtctctattttactcagtacaagtgcacacatatttatgtacacacatataattgtcatctttgggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgtggttgcgggcgcctgtagtcccagctactcaggaggctgaggcaggagaatggcgtgaacccgggaggcggagcttgcagtgagccgagatcgcgccactgcactccagcctgggccacagagcgagactccgtctcaaaaaaaaaaaaaaaaaattgtcatctttggaagctaagggccctgtatcagagtatcagaatatacctatatccaggatgcaatgttctccagttttgcattaacatcagctacaaggttcactgccatctaagactaatcaacagtaatagctaaaggacaaaggtcagttcctgagagatatgcctaaattcatctggctatatcttctgttcctcccaaaccctaaccccataaattcttcattgtttagaaggattcatattttttgtttgtttttcatattcccattttattggctggggttagaattgcaatggcagcaaaaaacacagaagctatctacagtggcttaaataaatagagttttatttatctccaatattaagatgtctggaaataaggtgctttgggcccaacagtatcaggactggcatctgtatattttttattgacttttcctcatgcaatatagcagccaccattatttcacagggtgaaaaagagaaggcaaaaagggtgtactatctgagtcttatcatttttataaagccaaaaatttcccagaaaccttttttgaaagacttctacttgtatatcattgtgtagaactgtgtcacatgacagccaccaacaaaaagatggctagggagaagtggttttcaacaggtattgaagtagctaaccggcagtgtctgccggtcttcagttataaacaccagcagctaactctggctaattcaagtcagggaaaacaaaggggatggggtaggggctctttatttaaaagatactcatagaaatgaacgaagtaatttgaaaactaggtctcagaataggacatgaagtataagagttctaaaatctcaaaagcaggaacacatgcatcttctttttaagtgttgtctttgaaatactaagctccaaagtctttccaaccttgtattattttcttcctttgtcagcttcctgagtggcagagtctgagtaacctatggggtctttgaactctttaggggaattgaggaaggcaaaaaggtaccatgattggcagctctactagagtcacaagaaatatggggaaagcgattcctcaaaggaaaaacaaaaacagaaacaacaaccaggcagttagtagaaggatgaaatactggacccacaaagacaacatatgtcttctcaccacacttggtctctctctctctctctctctctcacccttctctctctctcatagtaatgaaactaaagctgcaaaactaaggcctagctattcattgtgatccttatgagatcataaaaaaaatctgtatttaagtggagaaaaataaatggaatatcaactttaaaaaattttttttgagacagagtctcgctccgtggcccagactggagtccaatggcatgatctcagctcactgcaacctctggctcccgggttcaagcaattctcctgcctcagcctcctgagtagctgggactacaggcacgtgccaccacacccagctaatttttgtattttcagtagagacagagtttcaccatgttggccaggctgttccgaaactcctgacctcaggtgatccacccacctcgacctcccaaagtgctgggattacaggcacgagccactgcacccagctggaatatcgatttaattgtaagagaaaaatgcactagtttaaaaatgtgtcctctttatcctcaggttttaaaaatatttttaaggtagtttagaaaaactgaagtgattatttgataaataaatttcaaatgctatcaatggaacaagaatggatattagatatcctgctaacaaggatcatatttttacaagttgtttctccaaagagaacagagctacagctgagattctggtgcgcataaacctttccatcagagctgtagtcacctaacaattcttatatcacaatcttcatatctcaatcccttttccaaataacttcatctttcttaagttgcatacaaatgttataatctaatatttttgagatggatatcatgtgtcataaaaagaaagccattgtaatattaccaataccaagtattagcaaatattgacatagctttagaataaaaataaacagagctcaggttctggctctgccatagctagctagatttatcttaagacttcagtttcctcatatacaaaatgttgatagtatcatcatcttgtaagccttgttgtaaagagcaatttagctaacagtaacagtgtttaacatgcataaagtgaagactcctttctgggctgataagaacgctagtttattcatttgcttatttctatatttttaagcttagagtctgaaaattttcagagtctgggagtcaacgtgtggggtgtgaattggaacttcaccacttactaacaactcccttttgtagtgcttccatttatttatctgttcaataggagtaataatagcactcgctcaaagagttgtctgaggattagatgagacaatgcttgcaaaatgcaaagtggagcacctggtgtatagttggtattcaataatttctagttgttgatatgatgatgacgatgatgatgtattctcttgatatgtgaatgctcatcacaccatcctatggaatatttgattttaagaaaaagttgggtttgttttttttttttgtttttttttttttttgagatggagtctcactctgtcgcccaggccagagtgcagtggcgcaatctcggctcactgcaacctctgtctcctgggtttaagcaattcccctgcctcagcctccagagtagctgggactacaggcgtccgccaccatgcccggctaatttttgtatttttagtggagaccgggtttcaccatatttggccaggctggtctcgaactcctgatcttgtgatccacctgcctcggcctcccaaagtgctgggatgacaggcatgagccaccatgcccagccaagaaaaaatattttaaacaagttaagatcatttactatactgtgccctaagatgaggtgaacatgtagatcatgagatctaattgattttagatgcagttcagttttttaaaagaatgacctgctttccatattaaaatttcaaaacaatgatatgtggagatgatgacagaatatggctgaatgaggtaccttgttatcctcaaccttttggctcagagacctcttccttgctggaaactttcctaaccttttaatgatttattaacattttgcatgcactctttatacctttcattaatgactagttcactgcaaatttttctttgctttatttcctattcttggtgtgacattcattctctatctgtttctatggaagcttttgtgatgcctcagagagaaagaattctgagtctttgaaataatgaaaacattactaaaccataaaacctagatttcaggagcctaatagaggattagagctttattacgtacagccatcttacagtttagccttcaagtctcaattgtggaatgatcttttgtcctttctctccagtgtgcatgtgtgcatacacatatagacacagttcgcgcttcagtcatataaatgggaagccacaaagcttcctagagtacccagatgcagaattagaagacccaatcttgacaccagggtcaggggatctgtggtttggggggacttgtgctggctatattgttgtcacagcaggaacagtttgtgtcggtatagaggctttaacttctagtaaagggatatataatgaaaatgtaagcaaccatcgtttatttttctcacataataggaatttaagagaaagatatacccaaaattggtttattagctcaacagtttcattcagaatccaatgtctttccatctttgcatttgctatccttagcctttggctttggtctttggaattgtcacgcgatggttataaaatggctgccacactccaggaattgcatcatgacagtgtgaatggaaaataaaggaagagtggcagttcttgtcatgtttcagaagcaacagcatgtctccctaacatctctttggccagaactaggtcaagtagctgcatctacctgcaagggaaactaagaaattgactatcagtgctttttaaacttttttttgtgtgtgtggaaatagataatcactagagaaaaaagggagagtggaatggttgttgatgaggcaaccaacagtgtctaccactctatttataaaccttttcttgatttttcctactaaatgtgtggccgttttttttgcttgctttttgttttttgtttttgagatggagcctcactctctcccccaggctggagtgcagtggcgtgatctcggctcactgcaacctccgcctcccaggttcaagcaattctcctgcctcagcctcctgagtagctgggattacaggtgtgtgccaccacgcccagctaatttttgtatttttaggagacatggggtttcaccatgttgatcatgctggtctcgaactccagacctcgtgatccgcccatctcagcctcccaaagtgctgggattacaggtgtgagtcaccgcacccagccaatgtgtagccttttagttcaaggacctttcattataaatcttcatagtccaaacacccggcatattgtctggcacaaaataggaagaaatatttttggacgtgccaaggaatttgcaagacagtgagacaaatagccagtaaaaatgttagcattaatatattattaaaaatagtgagaaatgctccaggcgcagtggctcatgcctgtaatcccagcactttgggaccccgaggcgggcggatcacttgaggtcaggagttcaagaccagcctgaccaacatggtgaaaccctgtctgtacttccagctacttaagaggctgaggccggagaattgctggaacccaagaggcggaggttgcagtgagccgagatcacgtcactgtgctccagcctgggtgatagggcaagactctgtctcaaaaaaataaaaataaaataaaaagaaaaatagtgagaaatgttatgaagacaaagaataggctactttggaagaataatagtgggaacttcttcatagtctaggaaggcctctctgaaaaggatatatttaagctaaaatctgaaggttaggtcagtcatatgaacagggaggggaatggaataatattttcaagacaatgacctaaaaggaggcaagtatggctaggagctaatgactgagggggtgagtggtacaggacaaggctggagagtttattttatgggtaagcagagaaataatataatctgacgtacctgtgaaagtacacctgagctgatgtacctgcaaaacatcatacaatctgatggacctgctgtataaatgagagattgaatgtggcaagagtagaagcaaagaggccaggtaagaggcatttgcagttgtcttgatgaaagaaaatgactactgggagtaagatggcggcaatggaaatagagagaaatgaacagatttgagatgtattttcgagacaaaatctgtatgacttggtgatggattagatgtcaggcatgagggattgaggatgactcccaagttttttttgtttgatcaacttgttgtactgtttgctgaggtgataaagatggaggaggaagcagatttggaaaagatcaacagttcagttttagacatgttcagtttgaaatgtgtgtgatatgtccaagtgcagaagtcaaattcaattatagctcaaaggagagacccgagctagaagcgtaaatgagaaaaatattgatacaaaatggaatttagagcatccagaatggaaatcacttagcatgtaaagagggaagggaagatggcctaggaccaaaccttgataaacttcaagaaaaagaagtcaagcagaggtaggagaagagaagtcagtcaaaaatcaaaagaatatgacatctcagaattcaaggatgtgaataaatgtgtaagtgatggatggctttcggtctgggctttttgttttttttttccattttaagttccaactttgctacaatccggctacgaatcccacaccctcccaaattatctgaggatgttaattgatacttgatcagaaagcagtgatttttaaaatcatatacttctaaattatctgagatatgaagcaatgagatagggaagtggctgaaatatgtttctctggctcagctgtcatgagggcttgctctagaatggcactcaagcacatgtttatccactgagctctatatcatttattccattagctgaagaaggaatctctcacactctaacttcagttctgttggacatgggaataaaagttagatgtatacagactaaactaaacagatggtagaaaaacaaaggattcttaaagtatattggagaaatgcatttctatggtcaattttcttgaatatcctaagatcaggtttcatgtatataattctttacatttcacaaagcacctttagatgtgtctattccatttaaccctcatcctaactgtgtgaagtagggcacagaagtgtagaaatgattttttaaaactcactaagctaatcaatggataatctgtgattataatagaatctgagtttcggcatctttatcttattccttactgcactatatctggaatggtaaatattgttcatctcacaagcaagctcttattgactgatatcagctgcctagagtggtttattgtaaaagagcataaagcaaattggggaagactacaatacagtgccataggctgattagtaatttctaccattggtattaaatgagaaaataatggtacaagtgctttacatttgtctgccattcctaaactaaggcacctcctgttatttataaggaagaatattctgagaagtttaaaagtctcttgttaaatcatttgatgacgttggataaaatggcttaaaataagaatatgcctgttgcacaaataatctacactcccccaagataatgaataagtcagctggagcatctcaagtttcaatatgtagaggatcaaaatgaaatagtcataaaaccccttgcagacatttcttgggcaggcaaactaatttcctagtaaaagaagttggaagttggacaaattgtatatgggaactttctatactacttttgcaaattttctgtaagtttaacttttcctaataggatgctgagattcagctcttccaatggtctcaaatgttttttggttttgttttgttttgttttttgagacggagtctcactctgtcacccaggctggagtgcagtggcgtgatcttggctcactgcaacctccacctcacgggttcaagcaattctcctgcctcagcctcccaagcagctgggattacaagtgcctgccaccatgcctggctaatttttgtatttttagtagagacgggattttgccatgttggtcaggctggtctcaaactcctgacctcaggtgatccgcccaccttggcctcctaaagtgctgggattacaggcatgagccaccgctcctggcctcatttaaccattttgactttcactttttctgtcttcaaaatgaggtattgagctaggtaaacttaatgtcttttttcgctttaattatctaataattctgtgattctcaacttggtgtgttaaaccagattacacctaagaaaccctgaagactttttagctaggagtttaaatattcacttagtcattcaattaatatctattgtgggtctgttatatgccaggcgccattttaggtattgataataaagcagcaaacaagacaaaacccctgccctcaggagagcttacattcttgtaaagaagacagatgataggccgggcgtggtggctcactcctgtaatctcagcactttgggaggccaaggcgggtggatcacgaggtcaggagatcgagaccgtcctggctaacatggtgaaactccgtctctactaaaaatacaaaaaaaaaattagccgggcttggtggtgggcacctgtagtcccagctactcgggaggctgaggcaggagaatggcatgaacctgggagctggagattgcagtgagccgagatcgtgccactgcactccagcctgggtgactgagcaagattccatctcaaaaaaaaaaaaaaccgaaaaacaaagaagaaagatgataaacaagtacacaattatcatataacaattttaaatagtgacagcatgttgaaataaataaagcaaggaagacgctagagagttgttcatggaaggaattgtcattttatataaggtgatcagggaaggttccactgaggaggtgacatttgaggaaagacctgaaagaagtggggagggagacccgaaagttcatgaggaattgtgtcccaaacagggcaacacataaaaagtccttgaggcaagactaagctgattatataacatttaaaagaattaggccaggtgtggtggctcacacctgtaatcccagcacttttggaggccaaggcgggtggatcacctgaggtcaggagttcaagaccagcctggccaacatggcaaaaccgcgtctctactaaaaatacaaaacttagccaggcatagtggtgcatgcccatagtcccggctacttgggaggctgaggcaggagagtcacatgaacccaggaggcagaggatgcagtgagccaagattgcaccactgtactccagcctgggtgacagagcgagactctgtctcaaacaaaaaaaaaaagaattaatttacatatcatgagatcatctagtctaacacccttactagacaagttcaaaaaggttaagacttggccaagatgacacagctatttaatgtgatatctgggttagaattcacctcatctgaattcctctcaaattgtgctctttgaggtcaatgtgccttttaaaaaatgacagaaagcatggctgtagatttcagatcataccaaatttgatggaacaatgaccatttttagcttcctatagagtctaagacttgaacttgccaagggagtcacagctggatttgtaagcatcaaatccacaaatgtacttaatgtcaaccaaggattttgtgtcacctgtaatgctcccccaggaagcccccaagtccactagtcctaatcactgtgtttggcttcataacctgttggcccaaacattacgcaaaaaagagcaatattcccaaggtggtcatgttagttgtggtgagatgtcaaccataagtagatctgaccgaggaaatgccttaaggaagcagctcaggaacacctgagtatatgtgtctagaatgaagcctattaaaaaaactactgcagagctaaagacagctgaaagccattatgacagtcacaactacttgatagattgaaaccaaagagttcctttgtgattagatagatcaggactctaaatcatgtttttacttcatgtgttcattcattcatcatacagtcagtgattcagtaaacaatattgagcatccattatgtgccaagcactgtgttaaattctggaaacacagagatggattagacccctgtccccagggagcataaagactagcagagttagacctccctcccatatgaagaaattaaatgaggtaaggcattaaaagtgctatgattacataatacagaacccaaaggggaaggcattttctgaaaaacagaaaactgaaaataccagcttttcagcctcacacagacataggaaaaccaacccccatcaacatcatctcttcttttttttttattattactatagtttaagttctagggtacatgtgcacaacgtgcaggtttgttacatatgtatacatgtgccatgttggtgtgctgcacccattaactcgtcatttacattaggtatatctcctaatgctatccctcctccctcccctcaccccaaaacagtccctggtgtgtgatgttctccttcctgtgtccatgtgttctcattgttcaattcccacttatgagtgagaacatgcaatgtttggttttctgtccttgtgatagtttgctgagaatgatggtttccagcttcatccatgtccctacaaaggatatgaattcatccttttttatggctgcatagtattccatggtgtatatgtgccacattttcttaatccagtctatcattgatggacatttgggttggttccaaatctttgctattgtgaacagtgccgcaataaacatacgtgtgcatgtgtcttcatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgctatttctccacatcctctctggcatctgttgtttcctgacttttgaatgatagccattctaactggtgtgagatggtacctcattgtggttttgatttgcatttctctgaacatcatctcttaatataaaaagcataatgtgctgatttcacattgcatgcctgtatcaaaacatctcatatgctctataaatatatacgcttaatgtgtacctacaaaaattataagaattttttttaaagcaacaataaatatcttcattagtcaaccaaattaaatctattaatatatccatgtttgtgaacaggatggccacagaaccctgtggatgcttaccacttaaacatttcctgaaacaaatatgtttccaaaacatcttgcctgtctaatctgacaactgcagacatcctaactaggctctgaaggtgctctccatagcactgatgttattgattcagttgttaacagcgcaggcataaatgactgatgataactctctaaacgtcccttcctactgccgttgaaatggctctgggctttatccaagcagggctgctaaatgaatagtagatgtaccagcagaggagaaattggtcctgaggtgaattaactctcctgaggtagatttgtttgtgcttccaacaacctgtacgttaaaccttgtgaaccttcatgtaggaattttgaggagaaatgggcaatttttggaaagcctaatgttttatcagccgctttttcttctcattgagacctgtgtattctcaagggactttggaagtttgccattttaagaacagacttgatgagaattatttgaagtcctccacgtttccatttatcagttttcctaatacagacatcctacgcacatcgttgaaagaatgttctttttgcctcacaggtagatcacaaaagtgggcccataatcattgggtagagggtttctcagctctgagttaaattgcagctgggtattgtttttctgtaataggatcttctctgagtgaatggtgaaacatgcccatttttgaggtcatgagagcagagctttccacatcatggacagaaaagggcaaccggccatggtttcagttatacagggagaggaaacaataggttttgtctctgctttgctattgcttcaacagcagcatactgttggacactcagacattagggcacaatttagacttgtttcacagctgtcatttctttcctcaaaaacaacaaacctgcatgggggaaatgagtctacatttcagggtttttcaagaattgataacataacatgtacttcaccatgaatttatattccacaggtccctgttctcttctctggtcatcagagtacaaaatcacaaccaaaaagcaagaattgatatctatgaagctaaagtagtagtagtagtagtagtagtagtagtagtagtagtagtagtagtagtagtgaagcaggatattaccctgatcccctcgcgggcgggaactggactgcatagccgcttcggtgctggcaggggcagactccactggctcagtctcactgagttccacccctcatgggagaggaagcacaggtgagtgggtacaggagccagggtgagtgcttttgggcgccagcaggaacaaaactctgtgtgggccccatggcagtgtctaggagggtgcccgcgacccttgaatccccagaaggagtgttacagggcccttttatctttgccatctgcagatggcttaagtgttaacagctcagtggagggtcagtgtgacagccttctgtactcgcacttgtggcacctcagatcttgcccattttccaggaggaatgaggtcacacaaactaattggagatggtaaatgcgggggattttattgctgatgaaagtggctctcagcaggaaaaggagctgaaaaggggacagagcaggaaggtaatcttcacctcgagtccagctgtccgcaatcagactcctctctgaagctatgctgccaggctgtccctcggaagtcaagccacttctctccaatgcacaaccatagtttccaacatccagctgcttctcctctgtgccggctgagcctgggatttttacaggcacaggatggagggcagggtgggctatgggtggttttggaaaaggcaacatttgagcaggaaaacagggatgtaagttctcactttgggccacagttccaggcttttaggcttaagggtggggcccttgccagagacccgccctcttctgtccagaatttccctgcctcctgtccctatcagtagtaatagtagtagtagtagcagcagcaacagaagtaatactaactactacataccaagcattatctacgtacttcatatctattcaccaacctaattgttacaactttcactcgcgtccgtgtgaagagaccaccaaacagtctttgtgtgagcaataaagctttgtaatcacctgggcgcaggcgagctgagtccgaaaagagtcagcgaagggagataggggtagggccgttctataagatttgggtaggttaaggaaaattacagtcaaaggggggttgtcctctggtgggcaggagtggggatcacaaggtgctcagtgggggagcttttgagccaggaagagccaggagaaggaatttcacaaggtaatgtcatcagttaaggcaaggaccggccattttcacttcttttgtggtggaatgtcatcagttaaggcaggaacaggccatttaaatttcacttcttttgtgatttttcagttacttcaggccatctggatgtatatgtgtaggtcacaggggatatgatggcttagcttgggctcagaggcctgacattcctgtcttcttatattaataagaaaaataaaacaaaatagtgttgaagtgttggggcggcgaaaattttcggggtggtgtggagagataatgggtgatgtttctcagggctgcttcgaggtggatcaggggtggcgtgggaacctagagtgggagggattaagctgaaggaagattttgtggtaaggggtgatattgtggggttgttagaagaaacatttgtcatgtagaattattggtgatggcctggatacggttttgtatgaattgaaaaactaaacggaataagagaaggagaaaaacaggtattaaaggacgaagaattgggaggacctaggacgtctaattagagagtgcctaaggaggttcagcatagccttgccagcaaagattatttactttaagagttaagagtggtggtttggggatagcaccaagagatatcagctgtgatggcttggagaaacagtgtaaaccagcagtgtaaacaagagcagggcatttatgactagttgagactggtgaataggagtatgactagacagaagataggagggatgacaagttttttggggtgcagtctaagttggtctggtgtctggaatgagactggggcctaataaaaaggagcgtccatacaggagcttaaatgggctgtaccttgtagcattctgaggacaggcctgaattctgagaagggcaagtggtaaaagtattgtccagtcctttttaagttggtggctgagcttggtgaggtgtgtttttaaaagaccattagttcactgaatactaagagcctgagaaactgcttgggtgatttgactaataaagtccagtctgttataggaccgtatagaggtgggaaggccaaaccgaggaattatgtttccctgtgggaaaggcctctacctatccagtgaaagtgtctacctagaccaagaggtattttagtttcttgactcggggcatgtttagtaaagccaatttgccagtcctgggcgggggcaaatcctcgaacttgatgtgtggggaagggagggggcctgaataatccctgaggagtagtagaatagcagatggaacactgagaagttatttctttgaggatagatttccacgatggaaaggaaatgagaagttctaagaggcaggctagtggcttgtactatagcatagcctgcctttgctggtgtgtggccattaggcctggtggaactgccatcaataaaccaagtgtgatcagggtgaggaacaggaaagaaggaaatatggggaaatggggttgaatgtctggtggatcagagatacagtcatgggggtcaggcgtggtatcaggaataatgtgggaggccggattgaagtctgggccaggaacaatggtaattgtgggagactcaacaaagagtgagtacagctgaaggagccggggagcagaaagcatatgcgtcaggtgtgaggaagaaaatagattttggaagttatgagaactgtagagagtgagttgagcatagtttgtgattttgagggcctctaaaagtattagggtggtggcggctgccgcacgcagacatgagggctaggcaaaacagtaaggtcaagttgtttggataaaaaggctacaggacgtgatcccagtccttatgtaagaatcctgactgcacagccctgcacttcagcggtgtgtaatgaaaagggttgggatgagtcagggagagctcgggtgggagcagtctctaaagctgtcttcaaggaatggaaagaggagtggggaaaggatttaggatctatggggtcagctaggtttccttttgtgagtttatataatggttttgttaggatggcaaaaccaggtatctaaagtcgaaagtatctaaccatgcctaggaggaaaaaacttgttgttttctagaagggattggggtttgggagattagtcagacatgatcagcagggagagcacgtgtgtttttatgagaattatgccgagataggtaacaggtgaggaagaaatttgggcttgactgaagtaatgggggctgtctgtgaagccttgaggcagtacagcccaggtaatttgctgagcctgatgggtgtcagggtcagtccaagtgaaagtgaagagaggctggggtgaagggtgcaaaggaatagtgaagaaagcatgtttgagatccagaacagaataatgggttgtggagggaggtattgaggacaggagagtatatgggtttggcaccacagggttgataggcaaaacaatttggttgataaggtgcagatcctgaactaacctgtaaaccttgtctgcttttaggacaggtaaaatgggggaattgtaaggggagtttataggctttaaaaggccatgctgtagcaggcgagtgataacagactgtaatccttttaaagcgtgctgtgggatgggatgttggcattgagcggagtaagggtgattaggttttaatgggatggtaaggggtgcatgattggtcgctaaggagggagtagaggtgtcttatgcttgtgggttaaggtggggagatacaaggggagatgtgaaggaggctttgaactgggggaaaaggcggcaatgaggtgtggctctagcctaggaatagtcagggaagcagatcatttagttaaagtgtctcggcctaatagggaactgggcaggtggggataactaaaaaggagtgcttaaaagagtatcgtctaagttggcaccagagtttgggagttttaagaggtttagaagcctggccgtcaatacctacaacagttatggaggtaagggaaacaggcccttgaaaagaaggtaatgtggagtgggtagcctccgtattgattaagaaggggacggacttaccctccactgtgagagttacctgaagatcggcatctgtgatggtctagggggcttctgaggcaatcgggcagcgtcagtcttcagccactaaaccgagaagatctgggaaggagtcagagagccttgggccagagttccaggggctctgggagtggctgccaggtgagttgaacagtccgattttcagtggggtcctccacagatgggacatggcttaggaggaatcccgggctgcgggcattccttggcccagtggccagatttctggcacttgtagcaagctcctgggggaggccattctggaggaacccctcgcagctgcagttcaggcatttggagttcttctgtgctggagatatggctggggtttgtctcacagtggagggaaggaattgcaactcagaaatacattgctacttggctgcctctactttattattgtacaccttgaaggcgaggttaattaagtcttgtggggtttgagggctggaatttaatttttggagtttaatgtcgggagcagattgggtaataaaatatatattgagaataagacggccttttgaccttttagggtctagggctgtaaagcatctcagggttgttgccaaacgagccatgaactgggcttgtttttttatttgatgaaaaagagcctaaacgctatctgatttgggataaagaaaaaggagcattaaccttgactatgcctttagctccagccacctttttaagaggaaattgctgggcaggtgggggagggctagtcatggaaggaaactgtaagccggaccgggtgtgaggagcggaggtgataaaaggattatagggtggaggagcagaggctgaggaataattgggcctggcgaggaggggagaggtcagatgggtctgtagaaaaggaagattagaaagactgagcgatgcttggggttgggactgaggggacaggtgggagggaaagaaggaagatttggaaggagttgcattgggaacagagactggggaggggcagatgtgtaaaagaatgcctggacatcaggcacctcagaccgtttgcctattttatgacaagaattatttagagcttgtaggatggaaaaattgaaagtgccgttttctggctatttggaactactgtcaagtttgtactggggtcaagtggcatcgcagaagaaaataaggcatttaggttttaggtcaggtgtgagttgaagaggttttaagttcttgagagcacaggctaagggagaaaaaggaggaatggagggtggaaggttgcccatagtgaaggaggcaagcccagagaaaagggagtagagacacggagagaaggggtggggggttcttgtcccccagaaaagcggagaaggggtagagacatggagagaagggttggggggttcttgcccccgagaaaagcggtacttgccgctaaaggtgaaggaccaaggcaggcgtccccgtgtggtcagacacctctgaaatgtgggtgaataatcaggcaggcatccccgcgtgattaaataccaagggaagactcttccgagtccgtgaccggtgccggagttttgggtccacggataaaacgcatctcctgtctctaccagaaaaggaaaggaactgaagttaagagaagggagagattgaagtggggcgccaagattgaaaggagaaagaggttgagggatagtgagaggttggaggagagagtaaaaagaggccgcttacctgatttaaaattggtgtgatgttccttgggctggttagtctgaggaccagaggtcgtaggtggatctttctcacagagcaaggagcaggaggacaggggatagatctcccaagggaggtcccctgatccgagtgatggcaccaaatttcatgcgcgtccgtgtgaagagaccaccaaacaggctttgtgtgagcaataaaactttttaatcacctggatgcaggcgggctgagtccaaaaagagtcagcaaagggagacaggggtggggccgttttataagatttgggtaggtaaaggaaaattacagtcaaatggggggtggttttctggcgggcaggagtgggagtcacaaggtgctcagtggggaagctttttgagccaggatgagccagggaaaggaatttcacaaggtaatgtcatcagttaaggcaaggaccggccattttcacttcttttgtggtggaatgtcatcagttaaggcaggaacaggccattttcacttcttttgtgatttttcagttacttcaggccttctggatgtatacgtgcaggtcacaggggatatgatggcttagcttgggctcagaggcctgacaacaacgatcttgtagataggtactgttgtaattcccagtttacaaataagaagactaaggtatagagagattgagtaatttgcccaaagcccacagctagtaagaagccaagattcaaacccaggtaatatggctgcagacctggtaatcctaaccattacattaggctgactctcgatagttaacttatttaagctagtgttaatcacatcttaacaagtttgagtaataaaatcttaggttgaaaggggccttcaagatctagtctaaatcctttcaggagttcttccacatttctgctagaaaacactttggcctaggcttaaaacttagtgatggggaactcctcactttgtaaagcagcctgttcagttcacaaacaccctaataattaggctgttatctcttgcattgagctgaagttgatcttcccataacctctgcctttctgtctatatgtatgctttggaaatatacacagtaagtgtaaaccctcttggcaaagacagcccttcaaatacttgggaggcattcaattccccccgccacctcccgctctactctcactaccaagtctttagaatagagtacaggtatcaaaatcaaaacaaacagggagtagaaacttagtgccagactttaagtattttttacttataaaatctttttgtgtaacgagtagagcaactcctaactgcatatatgtactaagtttgcaaatggggcaatttgtttttccccatgcactggcatcagaggtggtaaatgctggcctgtcagattcaatgcattttgctgggttagaaccgcaagggctttccaggggaccaagctctctctgctgtaatcattaaaacctgcagaatcctgtgtgactctggggagaagcccagtgctcttggccctcatccaccctcactaggaaagctgcttaaaactaggacagaagaaacaaccactggcttaggatcagtcctcagacctgccttggcactaccccttttattccaaattttgcagtggcacctccaacttcttggtcacgttttgtaccttgtctgtttcctcatataacttcattccaaattccaacccatgctctgacatttcctctccattcttgctagacaggaatttctggatattggatattggcccctgcccataccctgactctgtatattcttttgtcctgctgaccagtttgagcttctgaataacaaaaactccccaaccactttaaagtcctctactttagcttgatgggtccctctcctgtattttctgaccttgactctgctctctgtacaaatagtaattacactcacccccaagcagagaatctgtgtcaaaatccatcaggatatctaagcacatcattatatctgtcaacttccccagactcctgatctcaatcccttattttcaacaacctggcaccgacagagtataatttcttttgtatcatgatgcagtttgatgtgcttttcgaaaggttatggtggtgattttaaagagatctgttttgttagaggaaggaaggaaaatagtgctgtttgcttccatgcagttcctcagagcctatgccagggtgatttcagctcatgagagaatctaaagtctaaagagatgtgtggagattagaaacattggtgtaaaaaatcagattacggagacgtaatatccagggtgtcagaggaggcagggagcttcaatcatgtttgaaactataggtcccacccaacaggatgagaaaatacaggagaagccagaaaaggtacctgcttgtgggtaaaatcaattaaatggaatcaatggtatggtagccatcatttctttcttttcaaattgtggtaaaaacacataatgtaaaatttaccattttaaccattttttagagtatagttcagtaatgttaagtatattcatgttgtcatgtagtggacttgcagaactttttcaccttgcaaatctgaaactgtacccattaaaccacttctcatttcctcctttcccccagcccctggcagccatctttctactttccgtctctatgcatttgactattctaggaacatcatgtaagcggaattatacagtatttgttcctttttggactggcttatttcacgtagcataatgtcctcaagtatcacctattagctgtcattgcttgaacacggttttctgccaagcacatgatctcgttttattcccagcacaactctcaataacaactgtgtaccttttttccctttcacagattaggaataaaaggctctccaagactaggctcagaagcagaagcagttggagagttgcttgcagaaggattattgtcatactgggaagtgctctcaggatttacacctctaagaaactgaaaggggcatgactgcgcagaggaaaagctggttcaccatgcagttgcaattatggctgcagcaggagcatgcagggaagctctggagtaggtttggcctttcagagttgtccccagtaaatcaaatgggtgaagactttaacccatttatgctggaggttgcaaaaatgttttgtgaaaagtcagaccttggcgatgaccttgagcagtaggatataaaaaactcccacaagcttagcgtcccaataatggaacactaggcataaatgagttaatccctgcatcagccagtcattggccctaggtctctccctgagggaggggatgtagctgtgtgaggcagttccctgagggcacattccaatgaaggccccagctgtgagccagcagccaataaggcagcaggtggcccatgcatgcaaaggccctaaagaggaggtccagggtggagcgccacggtgtctactacagatgctgaaagagtaaatacattttatttatttatttatttattttattatactttaagttttagggtacatgtgcacaatgtgcaggttagttacatgtgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggtcttttgtccatgtgatagtttactgagaatgatgatttccaatttcatccatgtccctacaaaggacatgaactcatcattttttatggctgcatagtattccatggtgcgtatgtgccacattttcttaatccagcctatcattgttggacatttgggttggttccaagtctttgctgttgtgaatagtgccacaataaacgtacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgaccgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtacatttgtttgagttcattgtagattctggatattagccctttgtcagatgagcaggttgcgaaaatttttctcccattttgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctgaatggtaatgcctaggttttcttctagagtttttgtggttttaggtctaacatttaagtctttaatccatcttgaattaattttcgtataaggtgtaaggaagggatccagtttcagctttctacatatggctagccagttttcccagcaccatttattaaatagggaatcctttccccattgcttgtttttctcaggtttgtcaaagatcagatggttgtagatatgcggcattatttctgagggctctgttctgttccattgatctatgtctctgttttggtaccagtaccatgctgttttgcttcctgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaatttccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgcacattgcttttgtatcctgagactttgctgaagttgcttatcagcttaaggagatttggggttgagacgatggggttttctagatatacaatcatgtcatctgcaaacagggacaatttgacttcctcttttcctaattgaataccctttatttccttctcctgcctgattgccctggccagaacttccaacactatgttgaataggagtggtaagagagggcatccctgtcttgtgccagttttcagagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttgtaaatacattttttaaggtcacacaaatgacatatgggacagaacagtgtttaacttcaaaactcatgttctttctgctatactgggccttctctccgaaagaggcctaatttgcacactacagtcaagcttagaatctattcatagttaaaatgtggagtcaaagcccaggaactatgtccttcaattcatctttcattacttacctattccttatcattcccgctgacaccaaccattttttctgacccttgtcatgaggagtgaagttgtatcattgcagcagctttctacttgtactctatgcctaaaatctctccttcctccatctggtcagccaattgctgtcaagttaatcttgcaagaacactacttttgccagtttaatttcgcaaaactcctgctgtgtgccaggagtgtcccagacatcaggtagtctaagataagcgatagtctctgcccctaagccgtttgcaacctttggagagacaacgtcattatcaccaccagcacccccattaagctcagagctaatatatgccagatgagactctgccagtcactgtgctaaggacttgacatacgttatctcccttaattctaacaactactttctgaggtacctctgatgagtagtatcatttttagatacaaaagcagaaacttagcgagttaagtgctttgcccagtggctctcagttgagaaacgaggtagtcacaccaggcagtccaacttcagtacctgagttcttaatcatcatgtttacaactttggctcaacattgtcaccaagatcgggttcaaatacatccattatcaatattctttctgtctccttgtatgtccaaacaaacaaaacaaatgcttccctcctgatgaggaaagtctccaaatcttgatacctgctgtgtctggacagtttttcctgctatttgctgagtgctggaaggattccctcaatccagatgtgattgcagatccagctcaagctcagcgtcctccagggaacctttgaactaaccacccagaaacgagcctttcaccggacactactcattttcacatatctagatcttatttccccatctgaactgtaagtgtcttaagagctgattttgttgttttttaataaaaaataattcttagttttttttcttattaccaaaaaattattcgccattgaagccttctgaatttttaataagaaaactattggtatattgcttcaaaaagaaatctaagcttctagattcttgaaaagggatagtgacagaaccttagaattaatattcaatataactaatctgatgaaaattcagtcattgatacattactgagaactactagatctcagcatttttaattgtagattcacatggagttgtaagaaattatacacggactccacatacctttttaccgagtttcctctaatggtacacctgcaaaactctagttcaatgtcacaaccaggattttgacgtcaatattgtcagtatacagaacattttcatcactacaaagatccctcctattggccttttatagccacacccacttccctgccccccctacctcctacttccagcaactactagtctgttttccatttctttaattttgttatttcaataatgttatatgaatggaaccatacagtatgtaatattttgggatggacttgactcactcaacataattccctagagatttctctttttatatgcagcaagacttgtttcctttttatcgtgagttgtatgctatggtttggatataccctagtttatttaatcactcaccccttgaagacatctgagttatctgtagttttggactattgtgaataaagctaccaacattaatgtacaggtttttgtgtgaacataagtttttatttccctgagataaatgctgaagagtgcaattgttaggtcatatggtagttgaatgtttagttttaaaactgccaaacttttccgaagcgtctgtactattttatattccaccagcaatgtatgagtgatccagtttctctgcatcttcaccaacatttggtgttgtcattattttttatttttagccattctgatatgtgtgtaggaatatctcattgtgcttttaatttacgtttccctcgtggcaaatgctgttgaacaacttttcctgtacttgtttgccatatgtatatcctcctcattgaaatgtctgttcatgtcttttgtctattttctaattcaaaagtttttttatagttcggttttgagagttctttctgtatcagatactagtcctttcttgtgtatagggttttcaaatgttttctctctcatcttttcatcttcttaacaggggatgaaaaagaattttaattttggcgaggttgaatttatcgctttttccttttatggatcatgcttttgtgttgagtctaagaatactttgcctagccctggatcccaaagattttctcctgttcttttttttttttttttttgagacggagcctcgctctgtcgcccagcttggagtgcagtggcccgatcttggctcactgcaagttccgcctcccgggttcacgccattctcctgcctcagcctcccgagtagctgggactacaggcctccaccaccacacccagctaattttttgtatttttagtagagacggggtttcaccattttggctctcctgttttatatgtcttatagttttacattttatgtttaagtctgtgatccatttgatttttatataaagtatgaggtttaagttgaggtttattttttgcatatggatgttcaattgctctagcataattatttgaaatggctggcttgattattgaagtaaggtcagacttatttctctcctgggcttcagacccagccaccttctatgtttcttgtccaccacaacctgaatgtcccacagacacctcagacttaacatgtccccagcagctcattattatcctccttttgtcccaatccaccctcaacatttttccctccctaattgtgctgttcttatgaacgctacgcttcacccaattgcccaagtcaaaaattagggtattatttctgaatctacttttatctttaaatctaacatgatgcattgccaaattctgtcagctctatccccaagccatctcttaattcattcccttatttacacctcccttgactccaatatcttttgactcaaatgctacatagcctctaatttatctccctgatattgttcttgcttccgaatcccttttccacaatgcgcctatagtaatcctcctaaaatgcagatctgattaggtgactctccttattttaaagtctttcttattgttttctcctgccctaaggcagaagttccaacaaatcttgttatcagattctggattaaatcccggcctcagcagtgggacctaagatagtgcctgaatttccatgaacatttattgatgacaaagagggtcttaaataatgagtgatgtagactttccactgtcaacatcacagattctggtttttaatggtattcacatttgccttctccaagagtccaggtttaatgatggtgagacctatcctaagacctggctttgtagtgaggggttacctcatcacagaatcaagaagggacctcgggccgggcatggtggctcatgcctgtaataccagtactttgggaggttgaggtgggcagatcacctgaggtcaggagttccagaccagcctggccaacatggtgaaaccctgtctctactaaaaatacaaaaattagctgggcttggtggcacacacctgtaatcccagctacttgggaggctgagacaggagaatctcttgaacccgggaggcagaggctgcactgagccgagattgcaccactgcactccagcctgggcgacagagcaagactctgtctcaaaaaaaaaagggcggggggacctgggtgcaagtaattctaagaagcaggaataagagaacaagaagaatgaagcgacaaagaaagatgagcaattctctggaactgttgagaagtgtacagaagaaaacaaatctggatataggtagctacagcctgaaatatggaaagccagagcatgtgtatacctgctcctgctcccactggttgagaattgattcctttttcatctgatatgggcaagcattggatctgagtgggacacatcctctccagtgcacccctgccttttccgctgctctgaacttcacacaacgtcggaaagattcaaaacaatgtagaaaatctaagtataaatacaaaaaggaaacaagaagtttttctatcaaagctgtgaactatatgatatgagtaagctcaataaacactgtgcagaagttgggaggggaaaaagagaattgctgccaaagcactaacccctgtggctggctatgcttgcccacccaggaagctcccatgtcatgggggtcaggggaacctagaacagaaagctgaaaggctcagggatcccttttgagaagggatgctggctatacagcacgagttagaacttgcacagaaccgtccactactgctgacactggaatcacaggtgggctgacaagatgtgatgcaagcaccagacatatttgctacaaacctcaaagtggagcagagcagcggcagtgtcagtcttcttggtgtcaatagaatacctgtttatttgttgaattctccctatatgaataataataatacaagaattcaaagcaggataggctttgtgtcattggaggagtatggagaaccatcagtgcagtaagtgtcgtgggaggtttctagacagtttttaaaagtcgatattgagtcaaccatcaaatgtgaacaattctgatatgccagagcatttgtattcttaactcatggggttattacaaagatcaaatgaaataatcattataaagcactttgtgcagtgcctggcacaaagcacgcactcaatacatgttaatgtttatacaattattattattgattgtcagaattatcagccccacatcagcaaagaatagtaggtggtctgtcagcaggaacatggaaacattctcattacatagaagtcagtgttgcagggacagtcattaaaacaggatctaattttagtcttctgagggaaaatgctaggttctccggaaatgttgaatccttcctcgagcatgtagtttaatttttcaaaattatattgcatatcctgtaaaatgaaaatgaaattgtactgctgttcattaaaggcccccaaaaatcttaggcactatacaatataaatgaaaaaaaaggcgttatttttccatagggcataattagaaataaagaagcaaggtcactcacaaatttccgagctataaaggaggaaaggaacaagattttcccccggttattttatagctgccaggttgaactcatacttatccaatgagccccagaatggaataccgttctacaccaactgtactgatgatagtgattcagggagtaaatgataagattccatccttctaaagtgcttttgggattggattctagtaagtttcattttgctattggccaatcacaaaagagactacaatagagaaaagtgaagacatcatgctgaagacagactgctgcatagaaaaggaagagggaccccctaatttagagatatggatggagaaaaaaaggcacttatgctgtagcataagggaaacattaaataaagctataatagaggagaaaatgtctttgaatagaagaaaaaaatcagacagacagaaatagactaaaatgctaaaaaaaaagatacaaaaggacattgaaggggacatacagtgattattacacaaattaaatgcacacagttaaaagggaggtgaaaagcttctaaaaagaatgagtgtgtagtgaacttaattttatcatctttactaagacaaagttaaagtccctaaaatattttaagacacttaaaaaaaaaagtcttaaaattttgagagcctttcagctctgtcaactctagactttccctcctacttaagttttttttcttttttttcttttatcttttttatttatttatttttttttttatgttttttttttttttttttttttttttgagagagagagagagtggatcagccttaataagagaatggtcttctgccaggtggtattctcctaatccctttccagtgagatccacaagggttcaaaaccactttctggggtcttagaggcaccacttatctctcttcctctgctcatatctttctgctccagtgcccgcatagtttgtgttatcagtggtgcgtagcctgagacatccacgacctatgccagctctcgaagtaatgtgattggcatccaaagaaacacaagaagcccatgatttcgtccctttgcaatttaaaatcatatttaaaatgccttttggtcatacaaatttgaaaatgatcttgtaaatcacttccgggaatctatggtcaaaactcagcttagagttctctacttcttaacagagtgcctgccggtaactagtgactgtcaatgagtttgaaaacataaattgatgtgcaaatgctagataatagcaacatcctgtgcaactgggcagcatttctgttgtttggcttttttattttcgtggactctcccaatctgagagaaaatagatttgagttcctttttaatcggtttagacccagacaaggatttaattggtttagaccccattcacctacgtgtgtcactctgtctccaacataacagaggagatgaccaagacaacatgctctccagccaggaggtggggaatactttggtgtcatagcagacaattattgatggaaaactcatgttagaaaatgtaaggtaccttcttctagacggagtaaaaggggcagctgcccagactttcattttaaatagggagcccatgatacaaatcttttaatacaattttaaaaagaagagacatagggggtatctcttaggacctgtcaacaaccaaccctctatcaaatggccaaatcacaggtggtctgcagcttagccaaaatgtccaagtacctttttgtaacacagaatctcctttgaagatccagctttcattaatgatccccagcagctctggtcaatgtgtcttttcacaaatgaagctttttaaaagctttcagtggacaaatgtggctttgagttttcaactaaatctttctgtttaaaaggagtgctgaaatgggcatactttataatcttaaatgctgcacacaaaatactgaaatattattgaccctgagaggttggttcaaatcaaatagcatactcacgtaaacgttctcttttcctaatattagcaacagggaatgtgaaatagagaggggcgggatatgctggataggggtgcaccaaaattttcaaaaagcctcgaaactagtgtatattgataaccttgtggcatctaatatctagtattctttttttttttttttttttgagatggggtctcgctctgtcgcccaggctggagtgcagtggtgtgatctcggctcactgcaacctccacctcccgggttcaagtgattctcctgcctcagcctcctgagtagctgggattacaggcgcccgccaccacgcctggctaattttttgtatttttagtacagacggggtttcaccgttagccaggatggcctcgatctcctaatctcgtgatctgcccgcctcggcctcccaaagtgctgggattacatgcgtgagccaccgcacccagcctagtattctatgtctattatttcttcataatgagactgggggaaatctttggagaattaatgccgcagttggtaaaatcattctataataatgggtaccattctgctctgtcccacatttttatgaagtctctttaaatttaaaaaggcaatgtgctttgtggttcttgagcaacttaaatacgttgctctgaatagttattgtgatgaggtaatttgtaacaacttttaggatcaatgctaattttcttaaatgtttctgtagtttcccctttattataaagtatattaggctggactcttggctgtaagtgacagaaaactcaactcagattagttaagaaacaaaagggtgttggtgacagtggtggctttcagactattgctgcaggcccacctgccatcctcttaacaccctcaacataccctgcagaaaagagagagctactctgacccgagagcttaaagactggtcaagtatgggcttgactctttatggcccaaattgggtcacatgcccacctaggctaggggaatggaatcgtggaattgattgattgattattgttgcaggttgagtcctccaagaagcagatgccagggcagatttattgcagaataacacctgtgaagaaataggggtggaagcagaattgaacaagggaagccatcagatcacaatgcagatcttctagactctgtgtcagcacaacaaggaatgccagagcaaagactgccaattagaggaatactgaattgggcagatctgacaatagtctgtatataactcgggactgttaacttctccttcctcaaccagttatagacatagaataggactctcttatctcaaacatcaatatctgtgtatatgaagtagagggtgaaagtttactgtacactagtggttctcaaccaagagcaagtctgtcccccaggggacatggcaatttctggagacattttcagttgtcccaactggtgaggaggtgctactggcatctagtgggtagaagttgtggatgctgctaggcattctctataattcgtgggatagatagcacaacaaaaaattgcccaggccaaaatgtcaataatgctgaagttgagaaaccttgctctataaagatacatgtcttggccgggcacggtggctcacgcctgtaatcccagtactttgggaggccgaggtgggcggatcacgagatcaggagatcaagaccatcctgggcaacatggtgaaactcatctctactaaaaatacaaaaattagccaggcgtggtggtgcatgcctgtagtcccagctactggggaggccgaggcaggagaatcgcttgaacccgggaagcggaagttgcagtgagccgagatggcgccactgcactccagcctggtgacagagcaagactctgtctcaaaaaaaaaaaaaaaaaaaaaaaaaaagatacatgtcttatgtgtactgaaagaggccacggaaaccttttgttgatacattcttgatagtttttgttcttatatgtagttatgaatacttgagattccatccaatttatttaacttttgaccagaaagggtagattgaattggtgaaacatctatatcctgaatatttaaaagattctgttttttaaaacaaatattaacttgaattaacgtaaatattcttagtagttaaagtccttaaagaccttagtttggtgaacagataagaatcatctgtgttcagcatatgcattgccttatgaagatggtaagtcaaaagtatgagtttatttctgatatttaaatatccctgaggtatagatttgtttactctggaagtttactctgttgtttgtttgtttgtttttgtttttgttttttgagacggtgtctcactctgtcacccaggctggagtgcagtggcacgatctcggctcactgcaagctccgcctccggggttcacgccattctcctgcctcaacctcccgagcagctgggactacaggtgcccgccaccatgcccggctaatttaatttttttgtgtttttactagagacggggtttcaccgtgttagccaggatggtctcgatctcctgacctcgtgatccaccagcctcggcctcccgaagtgctgggattacaggcctgagccaccgcacccggccttactctgttgttttatttcttcattatatattacaaagttgaatgttagggccaggttagatcggaaaacaagttaagtattccttatccaaaatgcttgggaccagaagtgttttggattttttatttttgtggattttggaatatttgcatattcctcatgagatatcttgggatgggacccaagcctaaacatgaaattcatttatatttcgtatataccttatacacataccctgaaggaaattttatacaatattttaaatacttttgtgcgtgaaacacaaaagttttgactgtgacctgtcacatgaggtcaggtgtgaaattttccacttgtgacgtcatgtcagtactcaaaaagtttcaaaatttggagcatttccgattactttggaaaagtctagaaaaagtttgatatcagtgcactgaaatcattttcaagtaggaacaatagcgatactagccctttactcatgcaaaattcacagtttttatctaaacaacacaaaatcattcaatgcttttatatttaatcatctatattcacctaaccataaaaaatcaatttcaatacagtaaggaaaagacaagaaaacgaatcattctaatcactgtattttgaaagttctttgcaaacaaccgtgaaatggttaaaagataggaggatggagaccagcctggccaacagggtgaaaccccatctcttctaaaaaatacaaaaattagccgggtgggttggcgcatgcctgtaatcccgggtactcgggaggctgaggcaggagaattgcttgaacctgggaggcaggggttgcaatgagctgagatcatgccactgcactccagactgggcaacagagcaggacgtctcaaaaaaaaaaaaaaaaaaaagatggtaagagaatgatgacttgttgcttactaaaataaaggaaagattgacactataagtgatactgtttgaaatctcaggaatctctgaatcattaagattatatcacaaatggcatgcaaaatacctgttcaaaaaatactcctcatggacatgagatgctaagctgctgatactgagtctgacctaggacaatgatgttctgtgtcacctcttttctgatgcctcccagattgctcctggcctcactgctgtctcacttccaaaaatacatattgcccttattggtcataacacagagactatcagttcaaaagtctctaattcgtctcagctgcagtcatctcccagcaagacacaaggttcttgagaaaagaaatttttcatgtcccatctttgccatccaccacacgatgaacatacagtacagtgtacatagcagcccttgaaaatgctggtggaatcattgattcttgaacccaactgtcatactttccagatttaagtcctggtaaatgattaaaatcgtatgggttaccctcaacaaaccagctcaagtatttactataaaaaagggaagctagatatggaacttcccctaaagatgggtctgtcaaactcaccccattgtattctgctctgacaccatgttttttgtttgtgttatttttttttaagagacagggtctcactatgttgcccaggctggtcttgaactcctgggttcaagtgatcctcccacttcagcctcccaggtcactgtgagagattacaggcttgcaccaccatgcccagccccaccttttaatacaaataagtaacagttaccatttactcagtgctcaccttataacagatgctgttaaacgctttacacgccttagctcatttttagttaaatacattgtttttgccccagctatggtagggatcttgctaacaatgagaatgaatgataagaggggctttaaggagaattcactgccacacctttcataattttcccatcattcctccagtctttgttcaaccgtccatgatttactgatttgctattacatcaaactatgctgcaacaaaccagtggttccttctgatttttatccatctcctcctcacctagggtgagagtctgaggcttccttgagtctactttctgatattgttacatttaacacagaacatctcttgttttcgtttctggcagcttatcctctcttcgctttctccatgctttcattcatcctaaaacaccattctgacaatgatatttaggttggtacataagtaattgtggttttaccattaccttcaatggcaaaaactgcgatcacatttgcaccaacgtaatatttttcttacttaaaaaattaatgtagagtatggaaatacttgccatcagggaatggggaagaaaatggctagagagacatggtgaaagagagacttgatttttaaataactttttttgtttttcttgaattttattatcatgtgaatgcatttgaaagaaatacaattttaaaataattattaaaaaaatatttgaatgccttcccatgaacaactaaatgaagtctctattcttaaacctgacagtcaagtacagctctggtttgactccaagctacatttctagccttgtattattcaactctttttctgtttatccttcatatccgggcctttactagtgccaaaaaaaaaaaaattgctcattctactcttgtcacccagagtgtttcttctgtttttgcccatcaaaagcttacccaattgtgaaggcccagtttcaaagcaacctccttcattaatttcatccagatactctgtaacccccatagctgtttaggcttgttctagcaatttgcagttatcagaaaaatgagtacataccgagtgccagaaagtggtctctccaactgtgcacattacaacatctcattctctgtgcctccatttcctcatctgtaaaatggtcactatggtgtactttcctcatagtgatgttcattctttcaagtagttagttaggtacctactatgagacaggcactgacctgggtcctgggggtacagtaatgaataaaatagattgagtcctgccctcatcaaatttaccttctgataagaaagacataaatgaaatatacctataatgctcttgaaatagcacttgggatatagtaaatgctctataaatgtttgctattattactgtcattgttggtagtgttgttatgtggtatttctattaacacataaagaaactaaggttcacaggctgttagataagatgctggttaaatagctagtaagggactccaactcaggtcttcctgagtcataaaattcgtggcatttccactacactgatggatgtataccaggctgtacatcagaactatctgtggagacttaaagaaagtaaagattctcaagcctcagcctcaaattaactaaatcagaaattatttagacgagctaagaatctgtatttttttgaaaagttctcaaatagttgtgatacactgtcaaattggggaatgactgcactacattaaaatctttcccataatactttattatgcttatttgtaaatatcaaatctacaaattcactaaagaccatccccttgttttcttatttatttttattttttctgcttcctctcctagcaaagtgccttataaacactcaataagtatttgagtaattaatggcttaattatttaaagttgcacttaaaatgcaaatactcacagctgtggtactggaagcctgttatgaacaatcatttatcttcctagggttatttactaatcagctaaggacaagcagttgggaaagaaaggctgactatttgggaacagaactgagaaggccctcaaaccaaatgttagccacgttattgaacagcctagggccccgccttaactttacctacacttcgttgacaatttcaggtaaaatgcagaaaatatacgctaacaatcaggagattcctccctcacaccattgtagtttcatttcttttaagccgacacatgtctctcttatggaaaatatgggaacaacctgttttaaagaaagaaaaagaatcctttattcttgtcacaccacaaacatggagttcactgctatacgttaagattataaagcaaaatcccaaaaacgcagtgactgattattcacagtagacatatgaagtcaggaagcttattttttctctctttgctaaggcacaaagcctggggctatatgcatttttattacactgtactgtgttgatttcacttgaggattaaaaagagagttgaggcacagtgcacgtatcttgatggattttaggatttcttgctttcgtgaaagaaagaagcttataaagtacctcagattatcgcccagggaagtgtacctacttccatgatgacctagaaattcaatcttttgtttctcctataaaagatcacattgtactttggatgttttccctgtagttttctgcactatgtaaagccacatttggaaaaacaaaatagttttagtttagagttgaagtgaaaatatctgaaatagttcaggaaagtcttatgagcatttggggagcttacaaacagccttgggggtggggtgagggggaatgagggaagagggaggcagggggagagaagaggagggctaggtcagaagtgtgcaaagaagacagagggagagagaccgtagagactgtgagtccatggcagagttttaattctggttctcacacatctacacagagaaacaatggaagcacattgctccatcccctgtcctttactaagaagcgtgaagtaaataacttgtggcttatgatatgcgaagaagagagaagacagaatgttgtaggatttggaagtacagtagatgagatcttccggtttattgatttgtaaagaacggcttgatactggtttgtcagttctgcatcagtgagagaaaagaaaggcgcttttcagtcacttgccagaggaggagagccgggaagtggaaacagggtcttctggcggacaagcttccttgagtggtggtcaaattgactgtgaagggagtcaaggtcaggaagctttggaaatgctgcaaggatggtacgggatttaaggagggttgatttcctcggttaagggttgttgcagacttcagcaaattcccccttccagcctttattaaagaagtgtttagtagaacaaactgaaaatctacaagtatattgttacccaaaatataaaagcttctgccactgagatgaaaatgtttgatttccagtgctttatctttttgcatttatctacctgtttcagtcattcgttaatatgaatttcctaatatatgccgtcttttttttttttttcggacaataccagttctatggtatctcactgatgattatttcaaattgccacttttgttccttggaaatactcctgtgttcaaataccaggaggcataattatgtaattaccatgtgaacattatgctacttatgggccaaaatgcccctagaaaggaatgctccaatggcctcagaaaatttctgtgagaacgatatcttccaaatgtggtataaataaagctcaagaataaatagctaaggctggaatgtaaatgatttaatgtaatgatgttgtaaggtgagagccacttgactttagttcctgttgcaaatcatgagatacattaggaaaacttttaaaagggaacctattttttaagataaaatctgtatcaagttacatcaccttccaggcaaagtaattcaactttcctcttttctctctgagaccaaaaaaaaaaaaaaaaaaaaaggcagaagaaatgcttcctatgatctcttctcttcctgtcacaattttcataagtctgtagatgtaattaaaactaaagattttgacaaatgaaacaggataggaggttgattgctgcttttctaaattaaaatgaatgatacccttaaggtacttgggtctatgaagtcaatttaatgttgatataacctgactccattatcacagaatgaggcagttgcataagcaagaaaaccaataaacaaacatccaaagtgcattttagaaatcggtgaggtgaaagattaaaggcttaacaacggacaaagagcttgctgttttgttctctcttgccttccagtttgatggcagagttcatcagaattagaggaagaatgttcttggagaagcgttgggctggcactaggctaggagtcctattcatatcctgcctcgcttgtcttgcaagcatgcacagccccttcatttgaggcactgtttgcctcagcagagtctgtgtactcttctggtaggttgtatagaacataataaagggggagggctggaggagaaaggacagaaaaaggagggaataaaaaaaggagtcagattaagaaagaagtcagcacagaaatataaaatggaaggaaaaaaagctgtgatgcaggaaccttaaaaggtagattaaggatggtctcagatggcacggcattagtatcaatgccataagtcacacaaaatctattaagaattatgctcctactcagagtgagtgccatgttagcactagttgtttcccgtgatctatcctgaagtcaaacgcaagaaacactgtttaactcctaagtgccctaatgtcaggaaaacacagaaataaactcaaaggaaagacaattcagttaatctttgcattcaacaagcccaggttgttttgccgcagagctatacctatcacaaaacttcattccagaagatggccggtagaggtggctcatgcctgtaatcccagcactctgggaggcccaggagagtttgaaatcaagaccagaacttatctcagactttttttttttttattattttttcagttacaactcaaaagaatcagaattagaataataatggattttaactgaaagggattaccattagttaaaaggattttaactgaaactgtaatcagtctcaggagcgtttcccggataatgtttgggcacgtatttatgagtgttacttgtgaggatttgggagtaagaatgaacgaggaagttcctcccccaacacagacacatgcacacagaaactgtacaaactgaaaaacttcaggacaaaaactcgtgaatagactggagagtcatttgtgtgcatatgtgtggtttatttactagcatcacagcacaagagtttctgtcttttgcttttgtttttgttttaataggctcatttgtgtaagtgtcatgtctgtttcttgcattcccatggatatttatctagggtctagacaaactgagaaccagaaaatcaaaacatacgttcctagttacatattttctctagactggagtaaacatgatttatgtatgtagtaatcagtaagatgtagcttggacactaggaagaaaccacattgcctagcagtgtatttccacatggggaggtaatgcctgtctctcctaaacttctagtgaagataaaactcaaagtagagtaattaacagaaaggtcaaaagacaaagtggaagcccttgagaatctaaaacaaagttaaagaaccaacatttacatttagataaatttatttgaaataatttctaagagccatgatgttgttatcggtcctttttctttctttcttttattcttttggcttatttaaaagcaatgttgaagaaaaaatgaaataaagcttatctttcacaatacacagaggaatggactgagctttgggaaacagtcacagcttggaattaagagtgtgtgtcgtatcgtaatttagttggatgatttggtgctcattcattatacccagaattacgctttcaagtctaccgtattcatacttatctcagtgcctgacaaataagaggaactcaaaaagcctttcattcattcatccattcagtatttcttgatcatcttctatgtactaggcattgtgataaattcttaacaagacagataagatctctgtctttgtggacaataaacttacattctagtcaatatcttttgaatgaatgtagtgatatttcttactgaagctaagaaaggaaggtctctgcaaacagtatactgtctacagaactcatctgaaatgagaagaccaaggagaataatatatagccctcataactctcaaatcttaaatatgattatttaaaaactagagtaaaacaaatgtggaggagatttggacttcagggttgttttataaattgccgttttacatttttaaatctagtattataggcaaaattgaatctaaatggttttcttcttttcttttttttactttcatcatcaaaaatggaagaaaggaagaaaaggaggaaggaagaaaagaaggaaaggaagaagggagggagggaagtttttcaaaagcttgtgtcagggatcttgaaaaagaaatgattcattcaaaatatagttgttaatagtaaagatccgtgaataaacagtacattaattcattcaactaatattaatttagcacctattatatgccaggtactgtgctactcactgaggatttagcagggaaagatgtgtccctgtcctcatggaacatataaaaaaggacctttttttcctgagatgcttttactgaagaattgctgcaacctagattatgagttctcatggaccagatggcagttttctgcccatctgggatagttctgaagaatagaccctcgtgtatcaatcaaggtttcttccagttctaagctttcgtgatctatgatctaatagttgaaacaggatgtatgcttccaaaaagatgttatatttgtattacttttataaaaggaaacagagacatgccctattaattcagaagagattgggttcctcctggctgtttaaatcattctatttaaactcctttatctcttctttcttggctcaccttccaaagctcactcttaccccttttagtctcacttccctttcctttctttaattgctgagacaaattgttcatctctaactggctatacatgacatctccagttaaatgtttcactgttaggacaaattcattatgttccaaatgaattcatacatacatatgctatttcttccttttctgattttcatattgccaccagcaatatcttcattctcccagtcttccttactcgaaatccaagagtttatttgcttcttcagatattaatctccaacaccaaattggatagttcttcctcctttcaaaataccttctcatatgtaccttcttttacattgaatacaatacagccttaattctaatgcatatcaacccaagtctagtaagttacaacagcctctttctgatctcagtctcaggtgccctttcgaatctgttttacactatactgatcttcccaaaccctaactttcctctaaaatagtgagtcatgtcacagaaattttcagtggttctctttgcctgcagggtaaatcttgagcctcagagtctgggacgccttgctttgcatcatcggctttcaacatgactaactaattgtatctcactgtcgtcctcaacaccactgttctgcagccccaagcctttcttcagcttgtcactacttcttacctccaaacctttacacttgcagagatcagggactatagcatttgttttttgcctatctctttcaatattaacaaatacttataaaatgaataaaccaccaaggaaagaactgattgtgccagaacataagacacaggtatatcatttctggcttttgcttcctgttttgtatataccacggtatattgatttaacatacagccagttagaaagatctaatgcatggaggctctcgtttaatagattatcaaatttcatttccttgcataattgctcaaagaataaagtgctttgttcctaagtcccaagctaaagctttcgaggactttggttgctttcaagtttttctcattcataaatttgtttctttatttagccagttgtgcattcaatccacacaaaacctttctccagtgataatttgtggaaagaaatattttatgcttaattcttctcgctgtcataccttctcttaagtttgagttatgaagatggaaattcactttgatctcattttaaaatcttgacaatattgaatgtacactggaaactaccactggagcgctccttgtataagaaggcaaaattcttcagagagaagattgggagtctagaatgaactttgatgctgcatcggctcagtccctatgaaactaacattcttactagagaaagtggcctatggcacagtcataatcctttaccatctacatcttccccttgggatttctttctcagtatgtgcaaagatttctgatcagtgtccactcccatatggcatcttcatcttctcctctctacccccaaacactcacatttatctctagattgatttattcatgaaatgacccattctaaatttagaaataatgacatatgcccaacatttatttgcacgcgttttcccacaacctttctctataatcttatggtatcacattcttcaagaccaggaattgaccttgcattgggccataaaatacgttgaacaactgcagtttcatcgatatgcacactagaattggtctgcattcaataaactgattaaagaaattaaaaagccaattacttattaaatatttataaaatactttttttcaactttaatcttcaggatagcagttaagagcaagacccagactgaatgagtttgaatcctagctctgccaatttactaactactgaagcttaggcaagttttttttttttaacctctcatgcctcagtttttatgtcaatgaagtcggggggaataatattaactcctattgcagagttactgtgaagatgaaataacataattcatattgtcatgccacatattgcttaataaacattagccatttttgtattgtatgtggtgccctgcacattatagtctattgctctccttttttgctttttttttttttttttttgagatggagtcttgttctgttacctaggctggagtgtagtgacacgatctcggcgcactgcaacctccacctctcagattcaagtgattctcctgtctcagcttcccgagtagctgggattacagatgcccaccaccacaccaagctaatttttgtatttttagtagagactgcgtttcatcatgttggccagaccggtctcgaactcctgacctcaagtgatccgcctgcctcggcctcccaaagtgctgggattacaggtgtgagtcaccatgcctggcctattcctctccttttattaaccataatagtagcaagaacagtagctggtaacatttattgagcaattaccacgtgacagaaactaggctaaatgctttacattgtatcatcttatttaattcccacaaaaccctataagttatattattttccacattttactgataaggaaagttaagaataatttacccagggacattgattagtcaaggttctccagagaaatagaagcaacaatatacatatgtatgtatgtatgtatatgtgtgtgtgtgtgtgtgtgtatatatgtatgtctatgtgtgtgtgaatatataaaattaagtattatctcatgcagttggagactaagaagtcccatgacctgctatctgcaagctagagagccaggaaaattggtagtgtgatttcagtcccagtctgaaggcctgagaaccaggggagttgatgatgtaaatcccagtgcaagtgcaggagaagactgacatcccagctcaagcaggcctgcagggaaaaaaggaacatgcctttttgttctgtttaggacctcaactgacaggatgatgcccgcccacattggggagggcaatctactgaatccactgaaccaaatgctaatcttgtctgcaaaacaccctcacagacacacccagaaatagtggtttacctgggcaccccatagtccagtcaacttgacacatagaattaaccattacagacctgcagtcagtgcactcagtgtcagtaggcatacttgtttgttccgcatcgcttctcttctcttctctctctctctctctctctctctctcacacacacacacacacacacacacacacacacacacacacgtaccacatttactcatttactcatccatttgtttggtcaactagtcattaaacaaatatttgctaccatatactatgtgcctcctgcagaaagggttggagacattcgaagagaaaggtaaacaaaaaatggtccctgctatcaagaagtttccaatctattgcaagacacactcatgtccatataactaaaatgaattatatgatagaagtgcttcaggtataaaccatatactgttagaatgctgaggaagccattaattctaacctgggagatgaggaagtaaacatataaacactaacagcattgatctgggagagaagtggggtaagagcattgccgagagaaggagcagcatgaagaagccacgcacaagagttatattggatggaatagtgcaggacaggcaggtagttttggtgggcttagcaggtagagtttgggagtgcagggtcataaggttgggaaggtaggtttgatatgtccctcatgcttttgtgtatataaaataaagtaaatcctgcattgtaggggaaccccacttggttatccacgtatttgggccaagcaaaaatgggcaagtctagggagagagtgaaaaaatgagattgttctggatatacactaggcacttaattgatattggaaggccagagttggtttgagaccaggctacctgagccacttttctgatgagattaacatcgatttttacctctcgggaattctgcacaccacgggaactaccccctgagttctgattgctctgtgcaagctctgatcaacccctagtttagcatggactgttcacaactaaatcaaaatccagagttagagagctaggatgcctggagccaccacttatattggattggcaaaatgccaaataagtaagtatagcatgtcacccgtaaaattattcctttcttccccaccaagaatagaactcactaagttgacagcacactgtgtcaatatattatagaaaaacctaataggaagaaaagaatggcagttttcactgcatgccccctaaaggtatatttcttaataatttccaagtccactgaaaactgaattccgaaaattagttttatcttactacccaccctattttatcccaaatttaagccttgcctgtacttctttgatacttaatatttttttctttgaggtggagtttcactctgtcacccaggctggagtacagtggcgtgatctctgctcactgcagcctccctcctgcctcagcctccctaggagctgggactacaggcatgcgccaccacacctgactaatttttgtatttctagtagagacgggttttcaccatgttggccaggctggcctcgaacttatgacctcaagtgatccagccaacttggcctcccaaagtgctgggattacaggcatgagtcactgtgcccagcccataattaaatattaatcaaccactggttaattaataattatcaataattaaatatcactcaatgatttattatctattaatcaatattgcttctttaaaaatttgtcaaaaacaatagcctaagacttaaagacaagacatgtcatttctgagattctgtagtcacctataccaaatgtcaccctccctaatgtttttgtgaaagtaaagatttgtatttttttatggtactaattgaagcagtagttcatttgtggctgccaatgagttgactgtaaaaaaaaaccaaaatctcattttaacattgtcgagagaggaaatcctttgtgtttggccttggattgataaaaacgagtctggaatactatatacggtaagtgaatattaaaactagagttatgaaatgttgctttagtgttctcagtcttggagactcaaagtatcttatcagaaaggatacattgttttaattgttcctcattatatagaatgagagaacatcatttctctccttttcctcccaggtggccgtcgaggaccgagtcaggcagctgcatgaagcccacagggactttggtccagcatctcagcactttctttccagtaagtcattttcagcttttatcacttaactttattgcatcttgattaataagaataacagttgaaaaaacaaaagaattaagagttgaattatagtaatcttttatcagatgcagtagaagcataaatcatcctgaaatataacttggttgataagttgagaaggttaggaagaggaaggccaattggatcattttgtccagtcttcagctaatgcataattgtttcctgcactatattctcaaatgttaaccatattaatatttttgagtctttttgaaaaatgtggaacactttgctcaggagccatgctagtattctctgtatcattattccaatgttagtatatgggctgctgaagcaaaaacatacttttgagtttttaatttctgcctatcagttcagttcataaagctaataattatgatatcatgtaattataatatgatcatccaatatatgttactgtgactctataattctttaaataattcattaaatgatccctgccttatgaaatgagtgacaattctcaaaagaaggcatacaaatggccaacaggtatatgaaaaaatgctcaacatcactaatcaccagggaaatgcaaatcaagaccacatgatatatcgtcttaccccaattagaatggctattattcaaaagacaaaaaataacagattctggtgagaatgtgaagaaagggaactcttttacagtgttgatgaaaatgtaacagtaaattagtaacagtatgaagattctcaacaaactgtaaatagaactaccttaccatctggcaatcccactactggttatccatcccaaagctaagaaatcagtatatcaaaagggtacctgcacttgcatgcttatcacagcactgtttaaaacagcaaagatgtgaaatcaacctaagtgtatatcaacagatgaatggataaagaatatgtggtatctgtacacaatgaaacactgcaagaatgaaaccatgtcattcacagcaacatggatggaactggaggtcattatgttaagtgaaataaccctggcacagaaagacaaaaatcgcatgttcttactcttgtgggagctaaaaaaattgataataaacatagaatagaatgatagatactagtggctgggaaaggtgtgtgggtagagggggagataaagagagggtggttaatgggtacaaacatccagttagatagaaggactacgttatatcatttgacagcagaatagagtgactgtagttaacaacgatgtgttgtatatttcaaagtaccaagaagaaagggcttgaattgttcccaatacatagacaaatgacaaatactcaaagtaatggatgcctcaaataccctgacttgatcattatgcattctatgccagtaaaatatcacattacctcataaatatgtaaaatattatatatcaataataaataaatactatgcctccaagttgaaacctcagcctatgggcatttcctttccctaactgtttgcatccttcctttttttttttttttttttttttttttttttttttgagagggagcctcattctgtcacccaggctgtgagtgcagtggcgtgatcttggctcactgcaacctccgcctcccgggttcaaactattctcctgcctcagcctcccgagtagctgggactacaggtgtacaccaccaggcccagataatttttgtatttttttagtagagacgaggcttcaccacattggtcaggctggtctcgagctcctgacctcaagtgatccactcgccttggcctcccaaagtgctaggattacattcgtgagccttgtattctccttttgttcttgacctctagccattctttttatttactggttttgctattttattaattatgtttttataattaatactaagagaaataaccttggttaactgaaagtttaagtattagaaaatcctatttatacaatattgcatattaaattggcaagcacctgttttcctctgattaatgttaatttataccactttttatttgattataaaagtatatgtgttgagttttttggtatttaaaaagccatactttaccacatggagttaacatctgttagcattctgatgtatttccttgtggtcatatatgagtatatatgagggtttatccatcattttaacgcaattactttgtgcctagaaatgttacagattttaactagtttaatccttatagcaatcccttcaatcccttaaggtaggtaccattattatacccatttcaatgatgaagaaactgaggcacacattcatacagctagtagatgagggagccaggattgaaactcaagaagttggctccagagtctgtgtttttaagcatcgcactgtaattttacttaatttatatattttatagagaggaagtaattctgtatgatctccattcttctgccatattctttcattgccattttctgatcatttcctttcttttccattctccacgggttaataaaaagatccacgctcacaaatactttaaagtatttgagtagatgttgtcatgtgtgtctccagttggctgttgtctttttgaacaaaatttcctggaaggtgttggtcctgtgtttttgtcatacatcgataatagattaagaagaagtatcttattttctggactggctctaactttattatccgcatgtggtctagttatttggacacagtttcacaatgctttggagttgccaagaaaaagggataagttaaagcagtttatctaaatgagtgggatcgtggcttttaggaacggctctagaaaaatgataaaggctacagatttcgtcttctgcatctttccaaatctctggtctacttaacttgccttggtgacagccattctattcgatttaattgagattaaatgtgataacatactcctaagcgactcataaaccataaataaaaaatagtactattatgaatattaattactcctcagacaccaggtatattcattcatattttcttctccctgactccccctctgaattcccatgtcttacccattaaaacctattttcagaaaatgatatactcatttaacccaagtgataggtaaagtttaatgtgtacttctcctgggttatttgcattttattagtgtgaaaatccataagcctgaggtggtagaacatcggccataagctctgagctgtgaggaaggaactttgaggggccaaggggagcattctcacacctttcaaaccatatcacatcagtgcccacttccagaaaggtcaggcctgttagacacaggtattcataaagagactgatctacctgcctgaatggagccagccccggaagtcatcagtctcttggatgcccatgtggaatatcaatatacgcttaaaagctttgcttgcaggtataaagaaaataccaacttggtttaagggatatttaagaaataggacggtgagactaaggatggattgtttctttacattgtactttttaaaattacaaaggtactctatacacatcaagaaaaatttggaaagcccacagtacaaacaagaaaagaaaaagtatccataatcctatgactcagagataatcactatcagaaatttggtttatatactttctgtatttctcttgtggttgcgtgtgtgtgtgtgtgtgtgtatcaaggttctatcttttatttttttatttttttgttttttgagacagagtgcaatctcagctcactgcaacctcccccgtcctgggttctagcgattctcatgactcagcctcccgagtagctgggattacaggaatacgccaccacgcttggctaattttttgtatttttagtagagacggggtttcactatgttggccaggctggtctcgaacttgtggcctcaagtaatccacccactgaggcctcccaaagtgttgagattacaggcatgagccaccacgcccggcctctctcttttcttttaaaccatgcgcagataaaaacatgctacagttttatgagctgcttttttcccttaaaactatctttccaatattttcgtgtgtttaaatattcttcttcagagtaatttttctaatgactggctaatactctcttctgtggctgtaccaaatttaccaacacaattctaaattgctcaatataaagattatttcacaatctttattatatcgagcattatggctaatatcctttttatacctttacaaatatctcagattctttctacaggataaatgcctaaaggtggaattgtcatgttaaagaatgtttacattcgtaagccttttcaagtgtattgccaaacttacctctagaaaattgcaccagaaattgggtgtgccatccaaaccgtatttgagctaggcatggtgtggctcatgcctataatcccaattctttgggaaactgaggcaggaggatcacttgagcccaagaggtcaaggctgcagtgatccataatccacccccccccgcactccaatctgtgtgacagagcaagaccctgaccctaaatttaaaaaaaaaaaaaaaatcaccatatttgaagcaggacatctctgaagtcacgtatttgctactataaaagcagcttccccccaccaatgaataaaaatatgttttaaatattcctctaaggtcatattaaatgaatttgaattgatacttttttttagacaggcctgagttgatacatgtttagtaatgtgctttcaggttactataaataataatagggtggctcctaaagcttagaaattacaaagaaaagaaaaataaggaggaactactaattgcacccgccagcgtaaacatgcttactgtctctgtttatcttattctctctctctctctgtctcgcacgtgtgtgcactctctctctctctctctctcacacacacacacacacacacacacacacacacacactcccctttggaaattatttggaaattacattaccagctgtctgttgtttatcagaagacagaggcagccttttactaaaaaaaagaattcactgtttcttcctggtggcccaatctctacatgttaaagaaattttttcttttatcttagatctaagagaaaatgagaagagaaaagcattgtgaaatatgacccttctccgctgatagacactaacttgtccttacttctagttttaatacactgctactcctaattgacttctacaacttaaaccaagaaaaaggagaaattctaatagtgtgacttcaaatatgtatataatttacaataaaattatcatttaaattatttaaattatatactaatttatagttatatatgtataattggtaggtatattgtcagtctcttcatatgtctgtgattaagaaagtactaaagtattcattggttggcatagtagtctgaaaattgtccttttcttttgaagagtttaaagatttgttgggcgtggtggctcacacctgtaatcccatcactttgggaggctgaggtgggcagatcacttgaggtcaggagttcaagaccagcctggccaacctggtgaaacccccatctgtactaaaaatacaaaaattagctgggcgtggtggcactcgcctgtaatcccagctgcttaggaggctgaggcaggagaatggcttgaaccctggaggtggaggttgcagtgagctgagatcatgccactgcagtccagcctgggtgatagagagagactctgtctcaaaaaaagaatttaaagatttttcctgaccattatttcaattctctggtcttctgttctaaattctacttttctcaccaagaaagatcactatatatttgggtaaagggagaaatcattctataacagtaaaaagaatccatggttttcttaatattttacaagttccagaggtcccttaaaagaatattttccaagccaggttctttaaaacattaatgttatattaggttttgataactgtcccttgaaaaaaatagtactgattaataagattggaaaaacactaggtttcaaagataagcaagtttatttcttgttagaattcttggaatttttattatacactgagactctaagaggataaggagtctatagttctccagttttaggtgactgtggaagcctttttcaggcacaccagttaatttcacactaaactttatgccatggatcacagtgaatctttgccttaatgtggtatttgccagatgctttaatgacaaaaaatttctgctaaaggttgtagaaacgtgatccaattaaaaagaaaatgagtatttatgaggcaaaagggtcaagtccctctctttactgaagttcccagccccactcccacccaggagccctcttgtgctgtggagtttcctaactggagataagcttagaaagtatctataccagtagtttccaaactctgaggtgtggctcattagcaaatcctaaaatcagtttaatgacttacaaccaacaatttttgactggtatggaatggaatggaatggaacagattagaaaatatcagagtgcattacctaagcaaggttaagtgttgttttggcggtggttaatttgttagatatgtgtgtacatgcgtgtgtgtgtgtgtgtgtgtgtgtgtgtgcgcgcgcgcacgcacgcgcgcacgccagatcacagtgtaaaacgtttttcttctgtgggttgcagtcgaaatagtttgagaaacattgaatcattcgagccctttccttattttacagataatgaaataggtgcagaacgatcaaatgacataaccaaggtcacaaagatagttataatactgggactggaacccagtttctggacatccaagccacacatcacactgccttacccgttaagaagaaatgcccaggccaataactgtctagtctatctgctattgccaacgattattctctcgtatattcctcttcgtttggccatcctaagttgatttacataacctaaatttttctctcaacacctctgggctaaaaactgccttatcaaaatggtatcgatagcggttaagagtaaaagctgtaaaatgaaactgactgggttcaaatattgactcagacactttatgcttttttctttctctttattcttcatctttaaaatagggataatagtaacatatttggtcaattgtaagacacacttttccacccacgtttcaacagttctgaaatcagaatgcaccatacgaccaatgggatattgaattcggtgaaatatggctgtattatttcatagggttacagtgaagatcaaacagttaatatttgtaaaacccttagagtagtgcctggaacatagtaagtgctattcaagtgtttgctattagctttagcattagtatcattattactatcagcttgatagtataacttaatgcatgcctgttagagtcaaactagtcatgaaagtttcattcattctcttgcatttaatggtcagtataagtagttcctctcctttctgaagatgatttccaaggatctaatctgaaagtccagtgttttgcacattagaacggctcaatagttgtttgtataactaacgagtgataaataatcaaaaagatagaccttaatctctaaaatgtcaggatagtattagtcttgttgacagttatattctacagtacctaatgtggtatgtggtacttggtagatgttcagtaaatatttacagaatgaattatgtcttatacccaaaagaagaagaggtaaattcactcttgacattgataatacacagaggcatgagatttagcatagtggctatcacatagtagacactcaataaataatgtgaccttttctgttgcttctcagcaaagactaatagcattcataactttatatggtcgtttttatcaaagtcgactgtaccatgtaatacattaagggaaaaggctgacttcaaaattacagcatgatcacaactatattacaaaataaaataaaaataacagaaatgtacacataaaggaaaaatggaaaataaaaagataccaaaagacaaacagttattgcatcatttctttctttttacttttacaaattttctggtaatagcatgtactacctttgtaatggaaaaaaaacaataaaggtaacattttatactccagcttttaaccagtgacctcttgcagtggcaatgggactctgaaagacaaatttcctttttactatttattctgaatttaaaagctgtttcattgagtgaccttctcagattatgagacactgtaaaaagaaataactgatccattatttcttgcaggctttacaatcttaactgccttaatcatatccctggttaagtctttttctctcttgtcaaagtgactcaagcttttacagtttctccttgatacatagggcctagcagtttgtttctatcttgagagttgccaagctttcatcctggacattccccactacacatacacacttaattttaaaaaataggggaaacctttaagcacatctaataattgctgacatttcacttaacagtgctccaacctatgctaccagtgtcctcaggggacagacaatttgaaatatgagtggggcaataatttaaagcttcagattggcttaaataagccatcatgaggccgggtgcggtggctcacgccagtaatcccagcactttgggaggccgaggcgggcagatcacctgaggtcaggagttcaagaccagcctgaccaacatggagaaaccctgtctctactaaaaatacaaaattagctgggcgtggtggcatgcatctgtaatcccagctactcgagaggctgaggcaggagaatcacttgaacccaggaggcagaggttgcagtgagccgagattgcgccattgcactccagcctgggcaacaagagtgaaactgcatctcaaaaaaataaaaacatcaaaataagccatcatgataaaagtcagaaagaattttgcaggtccaatgtgagatgatttgcaggctaaaattctctttcaagtaaaatctcagggtgaaatgatttgagccagtttcttcagcagtcacatgttgtcccaagtgttaggaatttgggacaaatgccatgtgacctaccagtgatgctgataatgcccctataaattcaaagacagcctttccaatgcccataaaaagcagctacagcagtaataattatattctcttcttaaaatgtgttgtcatggcccttttctcctttagctcaaatgtatactccccaataagctctcagatttatttgctttacagtatcattagcaaccagattttgcatcgttggccctatatatcccatcaatttgaacacatgaggaaacagaacgtttttgtttctgctatgggaatttctgtgctggggctggcttacaatggctcaagagagccaattgtaaaatatacaggaattgtgagctagttattaagcctacctttggtagcttgaaatcaggcatagtgggaagatttactccatggaaattggcaaatactacaaattggggcactttgttttttttttttttttttttttgtgcatagatggtttcccagaaatgactaatttatctatgttatttggatcactcaagtccctgtaggcaaagaatcttcataaacttagcaggaaggatgctcaggatccaaatatttatgtgcgttgcagagtgaccactcatcctggtttgtctgggactttcccggatttagcactggaattcccattttccaggaaatctctgtagtcccaggcaaaccaagatagttgctcaccctagccttaggtaaaatccctagaagtagagccctatttagatagatggggcttcttgtagaagtaatttgttcaggtgaaagggagtgagggaagcaggataaagtaagaaggatgctggtcaaggagttaagtgggaaggaagagactcacttcagcttgatcccacagggagctctggagaacaaattgtccctactttgagataaggggcctgggctttttgtttgtttgttttgagatggagtcttgttctgtcacccaaactggagtgcaatggcgtgatcttggctcactgcaacctccgcctcccaggttcaagctattctcctgcctcagcctcccgagtagctgggactaccgcgcctggatttttttttttttttttttttttgtatttttactagagacggggtttcactaggttggccaggctggtctcgaactcctgatctcctgatccgcctgcctcggtctccaaaagtgctgggattacaggcgtgagccaccgcgcccagccagggctgggcttttattttcccgtgtgaattagtcattggctgtggatttctggggagtaggagatagcaaagcagttcccatttggccaagggaggatttctggtgaaaggaccaatgaggccttagcaaccaacactcacaacaactgcggctgggtgaaccagctcagtaaaagggatctgagtggaacaacaatagtattaacctctcctagactttatgaagctgctatcataccccatgcataatctggctttagagctgaatgggcgcatttagctggatcactaaccaccactccttcgtcacggacttacatggaaattagcccggtggcatggaagagatgagacaaatgtctgtttctttcttatttcatcttcctcattgtgacagattcttctgggcctcatgaggagctagggccaagagaccagcaccagagttctgaatcagttttataacatgggcactattttggtggaatgctggctctgaagggtgtatttttacactacccagaaaatgaaggcatttgtgaatttggcctggggtagcattttgtcatctgtccaaaatacaaagctttgcacaacagaaatagtgggatcacatccctgtgggcaagaatcattactttcgtttttccatttggatgttttccattttcagaacacaaccagtttgggattacaaagtactttctggtgagaactttgaagtgaggacaaaaggcattttgttctttagtagacttacataaactgttcctggtttaaaaaccattctagatttttaaatagactttcagatatctgcagtaaaaatcatcttgatttcaggcgactgcaggtactgctctgttatgtgctatgtctccttaaggctgtaagggacagggataggcttaggtgataaggaacattttcaggatacagagaggcatgaagaataacatgggccgggcgcggtggctcacacctataatcccagcactttgggaggctgaggcgggcggatcacgaggtcaggagttggagaccaacctggccaacatggtgaaaccctgtctctactaaagacacaaaaaattagccaggcatggtggcgcacacctgtaatcccagctactcaggaggctgaggcaggagaatcgcttgaacccaggagacggaggttgcagtgagccaagatcacaccattgcacaccagcctaggcaacagggcgagactccatctcaaaaaaaaaaaaaaagaaagaaagaaaagaataacatggaacaacagacaccacgaaacatgtttgcttctttctgtatatgcatttgctgccatagacttcagactattacagtatcatatcttctctcttctctccacctaacaccttctacttatagtttctactttcttatgacttccattttcttcctttgttatccgactttttaaacttccccacccatctgtcatctctgtttatctctgtgtattacattcaagctctccaagacaaagcatctgattggattagttatttattatccatctaagggtaatgccatctcacaggccacaggccagactgtaaactaggctttcttgacctgggcactattggcatttggggccagataattagtggaatgctggctctgaaaagtgtatttttacactactcagaaaatgaaggcatttgtgagtttggcctggggtagcattttgtcatctgtcctagaatacaaagctttgcgcaacagaaatggtgggatcacacctctgtgggcaaaaattattgggggctgtcctgtgcattatctctggcctctactcactacatgccagtagcactcccctcccttagctgtgacaaccaaaaatgtctccagacattgtctgtctgatgtcccctgttgggtgaaattgcccctagttgagaatcactcctttataccaatgcctgcacaatttgtggtaatgaaagtcatgtggaacactaaatacagtgacctatgcctgaggaattatttgaagttgcttttctgcatccttagggaccctttagtctctcgatgaaagggagtgtcctcagcagacaatcttcaggaattgcatcagctgcctcacccaagatcataccccttacaggggcagctcttcctgatcagtgtaggggaataatgacctggccattttggcccaactcaggagaacattaacattctagctcaagagctcccatggggttgaatgagactgtcactgggtctgcattcaccttgacttctccctatttctattcctgtttctttcacttcccttccacagttgtctatcctgctctctaatcattgccttagagttggcttcctggaggaagccaatctgtgagggggcaatgaaattgacaggcatttagaagcatctaagaaaaaggtattataataggcccattacagtcactgggtaatttgatttactcttgctttcataatgaggttgattattttgttcaggataagtagtgattattattatttaaggtgtccaacctcatgatctccattaataggtaaggactttggggacagcataaaattacatgaatctcttaccttaaaccttaagctcagcagcatacatgcccatgacaggcaagagttagaacgtaagatggtcagtaacatagatcttgaaaggaaatatgttggagtgtgagcactttaagggcatagggcctgcattacttttttattaaaaataattttgcatctaacacaacatcttgcatattagatgcaggatatgccttgattgaatgaataactgggcacttaaaagattgttcccagtctaataaaatgaaagaacttagcctggtgcttagtctaatgtccagaaagagttaatgaacttcactttatcttcagtcagttaagaattgattcactttgttactcaacaaatgtctgttgaatgaccaatgtaaatcaaactctgatctaggaactggggaaacggcagtaaataaaacaaagtttatttattgtggagcttacattttaacaagagaagatggacaatcaggtcatgataagtttgatttaaaaacaaagaataaagcaggctaaaggggctagaggatgggagaaggggacccttttagtggagtggtcaggaatggtgacatttcagtagagatgtgaggaagtacaccagtcagatattgggggacaaagtgttccaggtggaggaaacagtaaaagtaaaggatccaagatggagcatgcttagagggtttgagaaatattaatagcaaggaagccagtatgactgaagccaaggaagaaagatggtgaatgataggaggtcagtgagtgaccaagggccagacgaggaagggtcttatcaactatggttggctatcgttaaaagcctttggcatatatgctttgtgagaagggaagtcatagaattctgagctaagaagtgacatggtgcctgtagcattgttacttactgtgcctgtagtattcattcattcattcctatatttattaacaaaaacgagtcacctgaaatatgaagataaaaagagaattattgccttgggacatttaaataccaatcacaaaagacagacctataaaaaatgacctcctacagtggtagtaaatagtgggtgcaatgggagtagaatggaagggaggaatccattccacagtgagagaaaggagatgttctatctagttgagtattaacgcatattgtccctgaggctacatgcaaatccaaagtagagggtattccttttgataggaacttagcaaagaatgtttataattgcttggtccctgatctcacctagcaagagtcacaagatgcattcagtgatgaaaaatcagtttctcccttctacttagccattctgataagatgaatatctcgggccgggcgcggtggctcacgcctgtgatcccagcactttgggaggccaaggtgggtggatcacctgaggtcaggagttcaagaccagcctgaccaacatggtgaaaccccgtctctactgaaaaatacaaaagttagctgggcatggtgacaggcacctgtaatcccagctacttgggaggctgaggcaggagaattgcttgaacccaggaggcggaggttgcagtgagccgagatcgcgccattgcgctccagcctgggtgacggagcaagactctgtatccaaaaaaaaaaaaaaagatgaatatctccctttccagtttcgtgtgtagtctccttaccgcccttctgttcagaaaagggatttcttacgtatgtataatgaatataaatataggttttagagagcactaatgttttaatgagatagaaataggcagacgagagagaataattgaaggattagtcaacatgagggcaatttgatagggaaagaaaaagtctgagcaggaaatgtctgtggaaaaaaaaaatcgaagaggaatggaatgaaatgagctcatttatggtgtgagttagggacagaagggatttattctcaggaggtgaaaagtgaaggagttcatgttatagaattcgacctagaccagctatcaagggaaagaaagtaattcaaaagacttggtccaggagatctggagcagatacatctattagaggaagattcagttttgaactgcatcttcagttattcctggaacccaacacaaaagctcatgacaaccttgttatcttcaggcaaaaaaaaaaaaaaaaaaaaaaaaaaggcgggggcagcaaggcttatgtcttaaacaagacagcacataacttcaggtcagagaattccattaacatgaatcacccacaccaatttaaataggaaaaaaaatagtaagcttggttatgtaaaaatttagtttaaaaatcagaaccaacaattgaaattaaacaagaatgttttatttatttctaaaaatatttagctatttattttgaattctgaagcaatactaatatagtatataatgataaaacacagttgattttcatagtaaacatcagcatcagaatgccaagaggaagatttgtctccgttcatgttttattactctgagaaccgcgtaacattttttaaagagtcagaaaatggctagaaaaagaggaagaaagattatttccttaactagttccctggtcccatgctttggtggttaacagtcagtttaactctagaaccatggaaagtctctgtcactttcctggttaccctgggattcctcacattggcagtaagttcgtgaatgagataaatatcctgataactagctacattaatgatgaaaataattataaacgtaggagttggaatttttaaaaagtatcgagcgctctgtgctcttaacacagaggaagcattttgcatagattaacccgtttaatcctcacaccaacctttaaaataaggactgttattgtctccatttcacagaagagaaaactgagactagaacaatttactaacatattcaagttcatacttgtaactattatggattatcagccttagaaaaggggttccagacaccagtgaatagcaacccacacgtctcaactgcacagaccaaagaggatgataatccccattaatctttgcatgttagtagaggcagtggctagtaacaaatgggagagactttggctggaggatattttttattctttaatctttatgatactgtttcccctctccccttctctctctactcctctctctgtcagctgtatccacaataatgccacaatataactactatacaagaatataaagcttctgttctcatgcttatgggtctacaggtcaactgtaattcgggtgatctggataaaacttgactggaaagctctacttcatactgaagcatgcctgggttcgcctctaggctgtgagttcagtttagatggtttctaaatgtgttgggttgtgagccccagactaaaggatcagaagcaacctggggcatgttctcatggcagattgccagtgtgacaagcctctgttcacatcatatctgctaaagcaagtcacatggtcaagcaagccaaggtcaaggagctaggaagcacactgcgctcaccatgaggccatggctaaggtatacatgtttagttctttcacaactgagtgaaaaatgggccccaaattcaatctctcctatactctttttgcgttaattgctagttctttctcactcttctcgctttctaatggatgtacatcccatctatgatcatttggtttttaatatctgagttgctccctactgtctcaggtttcaaattttactttccttgaaatttccctggtgcctaatacaatacctttcacacagagagcgttcagcaaatggtgtggactgcctgtcgtcttttaaaagtacatctgcagagacagtaaaggcacctggcgatattgcattgacttgttagtaacctgacttaacccagatggcccaaagactgtaaccaccattacctggaggaaagttccctggtaatgcagtcagccaattatgttcgaatttactcgaaaattccttgagcataaattattcatggctctatttatgtaggtatctatcttcctatatctgaccttaggaagcttgattgctttcttactcttctaataatcaccgtgatgtttttgaagttttctataagtcggttagaagcagcttttttttctttttttttttcatgagtaatgccgcccaactttggctattagactttgtgtgactgtgcagccatcagcactggatattagatatagttttatctctgcaactcagtcaccttgccaagaattttagtatgaactcttgacttcccagatcaaatgtgagcctgatactctaaatgacttggcaatctactgacaaatcccatggtgtggtattctgttcaccatgtgcaatggtctcagagctcagcattatctgtctgacagctcatataatatttacaggttgttattcgttaggaattttagttagccataaagattttcacagctatggcagacattagaggtctcattcatcactcttgtgaccttcctctctggaatgtagcccatctgtctctgctgttgaaatctttatggaaagtctgcccatctttgaaagtttagtaagtgatcttaaagttttcattgaatctttacttttgatatacgatatagacatataaagcactatccttattttaatttaacgttttgaaaagtgttaaatttaacttggcctttcatttaaatgacagaaaacttactcttgctacaggaactatatgcgtcacatcaaaagaaaatagaaatcatacagaaaaaaattggaatgggaaaaattacacatatatacatatatattcaacactaataactacatgaaagcttaaatactgtattataatcctgattatgactttaggaaatgaaaacgatagaaatacattttgcatataatttaacgttataaagaaaccctaagcaaattcagtaatgaagtgaactgaataggctgggttacagagcacaagagagggatgaccaacaatcagatgttgcccctttccatttctgttttcctctttttatacacaacttctcaaatgcttgcttcccctccgtctactccctccttcagcctctgatcactagtgtgaaattgcccttttgaggtcaccagtgatcgtgggatcaaatacatcttcttcttctacacccttagtctgtcaggctcaagaattgcttatacttcaccagctaggctgttcttgtgtttcatcccactttattctagcttctgtattatttttctttgacagcagttctactgccaccgccatttgggggcatttgccagggtacattcccttttgttttcctccactgtactcatctttttttttttttgtacttttatagctttcttggggtataattatatgcaaaaatatgcatatttaatatatgtaatttggtaagtttggacatatgtatacacccaagatactattgccacagtcaaactaaagataacgaacatattcattacctacaaaagttttgtgtccctttgcttttgtgtgtgtctgtgcatggcaagaacacaacatgagatggaccctcttttttttttttttttttttttttttttttgagatggaatcttgctctgtcgccaggctggagtgcagtggcacgatctcagctgactgcaacctccacctcccaggttcaagcgattctcctgcctcagcctcccgagtagctgggactataggtgcgcgccacctcgcccagctaatttttgtatttttagtagagatggggtttcaccacatcggccaggatggtctcgatctcttgacctcgtgatctgctcaccttggcctcccaaagtgctgggattacaggggtgagccaccgcgcccggccgaggtggaccctcttaatccccttaagttttaagtgcactacacagtattgttaactataggcactatgttgtacagcagatctctagaacttactcatcttgcataagtgaaactttatactcattgaataacaatttctcgtttcccctgccctgtcttctggcaaccacttttctatttactgcttctatgaggttgactatttcagacacttcataaaagtggagtcatacagcatttatccttctatgactggcttatttcactgagcatgtctgcaaggcccatccacattgtcaccaatggtaggaaccttcttttttttaatgctgaatggtattccattgtatgaaaatgtggtgtatacatgcagttctctttgtacgatcttccttccttaaagagtccagccattctcatagcatctgctatgattctagtacttatggtcttgtcctttcacttgcatttcagtgaaaagaaccaaacttatgctgatgcaaatacctgtacacaaatgttgataccagctttattcatgattgccaaatgctaatcagtctatgggcctctgattttcactgcataaaatatagactaatctgtttatcattcatgctgatgaatggtggataaatggtctagctaagaatgaaagatctgttgtatagatgtcattggtctaggaagacagagatgtagaaagaagtaccataagcccaggcagttagatactattcaaaggcatttctctctgccatactttatactacatgtggcacattaacagtagttaggagtggattcaaggctgcagataaatgctgcccaggtgagagagaaagaattggttccacaattaaccatcattcagacaacacatcatagctatgtgattacaaacattatttgtgtggtgattaacattttacaaagcaatttcatattgatttcctcattttatcctgacaacattttggtgagggagatatcattattcccattggaatataaggaaaataaggcttaggcaggaaaaagactagcttaagatcatgaagtgataggggagtcaggactcaaatccagttcttctgaatctgtactctggacattttctgctatatccagctccctctcaagatgctggattgggctttgaaatagaaagccaacatcctgagtgcctttctaaactctgagttttacagtctatcaggggaagaggagagtgtgagaggaatgttcccaaataatctactgtatcaagcagtatatctaacttgctttgagaattatgccaactaaatactattgacctgcagaaaattgatttttctctttacacttatatcaataaagagaggcttctgctgccataagtgtaatttatgtaaaatgtttttaaaacattcatagcctttaatcaagtaaatatacttctaggaattttgctttaaaaaagtaactaaaatatgtgcaaagatttatctacaaagatgttcactgtggccttacttagaacagtgaaaaactggagacaacttatatgttcccaaagagggaatttattcaataaatcatggtacatccataagtgggaattttttagcaatgaaaaatctgttgtaaccctacaagcccactcttaagcattcatcttagagaaatgaaaacttatgcttatgcaaacacctgtacacaaatgttgataccagctttattcatgattgccaaatgctaaaagcaacctaatgtctttgaacaggtgaatggataactaagctgtagtacacccatataatggcatactacttagcaatgaaaagaaacaaatcgttgatacagcaatatggattatgcattatgctgagtgaaataaaccagtatcaaaaggttacatactgtatttatatgacattctggaaaagacaaaacaagtctagtagatcctccctaatgccttttgttcaaccccagaggtgagttttctattttacctccagtgattgctgtatcggttatttatctaaactgtccccacttttttgacccacctatgttatcaaactccaaatccaccaagtatgagaaaagtagagagatgaatgaaggtatttgtgttggaattccagaaagtgctcttttggcatgtcttaaaataacattagcattctttttaattttctggttaggcccctatgttgattaaaatatgacttaacaccagggtgcatcacttggaacattctgttcatcatgcatttaaaaacggctgaaataacaacttcccctaaataatgtggcctgtgcttgtgattttcaaaactaccttgggcacaatattgaatcctgtcacctcaaggaaggaaaagcatttgaagatagaattgctaccctttcttgctcttaataacatactgtgtctgtaacacaaaaggaaattcagaggttggttttgcaataaataaatgcatgtgtagtttgctatctaaattcagtggacaataccccatgatgctggtgccgtatgataatggttgatttgtacattcaagaatctgaatcacaaagctgccctggaattacacgtagtggttataagcacatctgtataagaaaataccaaaggacaacccggtgtcatatagaaactatttgccgataaatttgcttttgatgggctactaaaaatggacacatcaggcataaaagatgtgtgtgtctattacgtaggctagctttatgaagaatgacaagcttccactggtacactgagataagaaacagctgttgttggcatcagtactgctacaagaaatgaaaaaattctgtggcacacttgtgagcactgccacatatttgatcaacttttgaatagatggaagaccagaatcatctggcagccccaaatgaaattgtcgacaacccttaagaatctcttgagaaggagcactgaacccaattccgtagaactatcatccaattgtgtgttatttctaaagcaagtagttccagtgtgtgtgtatgtgattatgatggggcagggaaggaatgaggggaggctgttgttattttcctttttttttttttttttattgtgtcaaggacatttttgagcataaaattgtaaggtttcaaacaatgactgcaaagcagttgcttaggtgaatttataaactgtgaatcaaaggggaaaaacatctttcagaaaaaaaatacactgaatctcaccattggacctatttgatggctacacataagacaaaaagcttttttaaggaaaataaatgaacacttaagaactgcaattacaaaagcttgaaatttcatattgatctagaatttataatatttttaaaattctttaaaaatattttcagctatttagttcaagcatattctgataacttctctgacatttaattgaaaattttccccttttaatgtaaacataaaaagtcaactctagataccctacgtaggtcttcccattagctcagccaggcaacgccaattttcctctgtctctcgctgcttagaggttgtttctttcaggccgaaagcccctaagccaggccaggcagccagcagccctctccagcacacttctttctgagagacgcctaagaatagtgtaggaaatccaaagtgattcttctgctatcagaggatggtctagcatcctccaaattagaaagaatttctggaccactagaatgataaaaaaaaaaaaaaactagaaaggtataataagagaaattgtgaggcctcagcccatagatacctttaaggaaagaatagccattcttttctcagtttaggtattcacaggcttggcattcacagccagtgagggctggaccaagagctctctggagttctcttcttccttttatgatgctggtattttaagaagaaggtacactgagcagccaggagctataatttctggctctccaccatgtttcctgctatagagggctagctttttaatatttccataacaacagactctgaccagataggtcaggaagtctagcccatggtttgtttgtttgtttgtttgtttttcagttggagttttgctcttgtcgcccaggctggagtgcagtggtgcgatttcagctcactgcatcctttgcctcctgggttcaagtgattttcctgcctcagtctcccgagtagctgggattacaggcacctgccaccatgcccggctttttttttttttttttttttggtatttttagtagagatagcgtttcctcatgttggccaggctggtcttgaactcctgaactcagatgatctgcctgcctcagcctcccaaagtgttgggattacaggcgtgagccaccacgcctggccttagcccatgtttttaaatcagatcttatttactctgtgaacttatttggacaggagagctgcatcctacagaagaaaaaaggacaagagaagagttgggaagagaatgagaaaggcaaagatggaaagggaagcagggaaggcaggaggaagggaaaagaaaggaatagagaaagaaggacagaaagaaatggaaagtcagagactacttcaaaacagcagctaaatgtcttttttctctgtattaaaaatttccgtctgccaaaatgaaaaagcataattaccggccaaatacaaatccatttcctatatcgtttaaatgacatatctccaaggtacaaaacagcatgtctggttaaaggttgggtgatttgatccctctattactctatataaaacaaagaagctggagtttcattacgcttaaattgtctggcagtgggtgaagttaacttttattagaagctgttctttcatattatacagtgtagtcgaggatatattagctttgacgttttcttacatctcaatacactgcggagtgaatttactgtgagactaatttaaaagggagtttttcataggaggaaataatggtcagcatcagctgtgcttcaaattattagcagaatgaaaattcaggggaaaaagtatagacacataaagttgctagatattaataagaatgcgtcttttatttctgtttctgataatattctgtgtttcttaaagctccagtgtcttaaaactatattcaggaggaagattatattgttgaggaaatgttatagtgcctcctcaacaagattattttgtcttaaagaaagaaaaaaaaccatcagatcaaacagtatataaaatatatttgtagaggttcagctttagggaagaaatcctacaacttaagcctgaaaaaaaaaaaaacaatgcaaagatcattcatttgaccaatacacagtgaagtcataataaaacaaattcctagtatgtgaaatgaaatttcacgtataggattcatcactcataacaaaagtcttattacgctctgatatcagtagacattccctcacttttggtcaccttttctaataagatcacactggtcagctgacattttgaggcaccaaattaagcatctatttggtaagtgaatttggattctctttaaaccaataaagataaaaacaaccatatcagagtgataagcatattactttagcttcaataacttagaatgtaaatatatcacagagggatatttcagctactgaaataataaaatccagtcagtcaaatagtaaaaaatattgagaaccagcaacaggaagtattataaaaaaaagcactcaagggagacacatacaagaaaccccgtcagtctactcattcagtttcttatctgttctataggtttagcagtggaaatgtttgtgggttttttttttcttcgcatttatctttgtgcctgaatgagttcagtttcgcttagattaggacagaaatttcagaacagcaggttaatccatcctgtcttcatgggcagctgagcaaacagaccaatatcagtgtaaaattgtaattctggagattaatgttgtctttcctgtttgcgatgaatttgacctccttgcctttctttttttcctcccttcttttcagcgtctgtccagggtccctgggagagagccatctcgccaaacaaagtgccctactatatcaagtaagttggaagtatcacatttttaaaagagcatttattgtgactaacctgtatattcacaagtgagtttatttttaaaatgcgacattagcctggcctacaatacctgtgtcttttttttcctgaggaagcttggataaaaaacttattctaaaattaccattgtaaatttgctgatgcaatggggaacgacttttaagaaaagtttatttaatgcaggatatatggtgtgttttgtgacagagggggcggatttttcacaatagaaccaaaagctccagataattttattgatagtgggagtcaatctttgcgagaacaatttcttttatttaggggttttctcacatttcttcttccgtcaaagatagaagatttccgcagttatatgtacacaactgttttgggtgaatgaatactacatgtttccaaaaggcagaaagcagcagtcctcgactcgtagggcttagttgttcattcttgatacataacactcagtatttgtcacctaacaacagaaagatactgttttctggaaacatttgtgccagtcaaaagaatacgagtgcttggaagcaccttctgtagtattttgcatgaaatataaatgacaatacattgggtcaacgtggaagagagaggagagaggatattgagtgattacgataccttcacagtctctcatccattgtgcactagagtctaacttaaatttaactttgaattggaaacctcaacaacaattacaatttactgggttcataaaatagtcctcgataccaaccgaagtctttgaacttgcttctgccatgagtctgactaaaaatattagatgttttcccatttttttccgcctgccatcttttatcgaatctgtttttattctttcactgtccatcaattcttcttaattcggttctaaagcaataacagcagtcctagatcttcattactacagtcctcaagaaatttgattttatgcctctattttgttaactcagaaaaatgggagtgaaggtagtcttttgactctttcaggagaaatacatactttaggaaacggtttaccatttgtcttattacatttttccagatgaggtatctcttaacttgaaaattcttttttagtatgtttgattctgctttttagttttcatattttatgaatttaattttattattgttatatttaattcattagtcactcaaaactgtacattttaaatacctatttaaatcacatgctttattaaataatatattgctgtagacatgcactgtatattaccttacatccactgtatattttatggaacaattttcttcaaactctagacagtgatttcctacatcagtgtctttgtcctcacaaatttttatttccgactaagatgtttgagacctgctacttcttcaaccaattcataaagctctcacttttatccaattcctttatgagctgaaataaagactctttttctcctttcatagatgaggttttaggatcactggagaattcaagacacctttaagctattattctccaaatgactacttgtttggggctcactagaggtctcacatggattgctagggtctccccggtcccattgtcctttccctatatattcatcttctccctgatgttacttctactacaagagatcccagtacattgctgtgagggaatggaaatgaactccgtccaaaaaataataaagagacaaattccagaaaagctgtaattcccttctgtgtattagtctcttgctgtttctcagtggaattagagagcagctacatatcctatttgtccaatgctccttcatgtacctaaagaccatggtgatggtattgataagggcacagatctatgaataagaaaacttcaattttagtcctccagtctagtcttagaggctctgtcattaggcgactgtatggctttaggcaagtcacttaacctataaaaatcttggtttctttctttttttttttttttttttttttttttgagatggagtttcactctgttgcccaggctggagtgcagtggcccgatctcggctcactgcaacccctgcctcccgggttcaagcaattctttcgtcttagctcccgagtagctgagactacaggcacctgccaccatgcttggctaatttttgtatttttagtagagacgaggtttcaccatattggtcaggctcgtctcgaactcctgacctcaggtgatccacccgcctcggcctcccaaagtgctgggattacaggcttgagccaccatgcccagccaaaccttggtttctaatttataaaataaagagttggactagatgatatctaagatcctttttagctctaagacgtaatgagcatgactcattcagttgtcctgtccaaacttaaaaaccgaagatctcagcttttgttcgataatatctttatttttaaaattcattattttaatgaacataatgtaaattcttactttaaaaaacaggaattttatttttccactgtttaattagctttagatatgccctatcaacccactccaatttcaccacacacctctttaaagagctcaaatcttggtatataatttaggattattatgcttcctggctcatgataagagagagagaacaataggcaggaaaatttgccaaaaggtgagtatggagaccttaaaagcctctgaaataatcagttccttgaaatgaggaaattacgtaatttctcaaaaatatctctgaaaccttatggagagcaattctctctacaattataatctctttgaaattagggatggtataatttctcaaatatgagtgtaaaatgttaaactgtaatatagggaaaacatacatgtttataaaatgaacattgtcagtaagcagatgattaatggcacttgtgtcttattagccattactattatctaaaatgttctatggaaaccaaattaatttgatgtacaaggttcggtggactttatgcacagcttaatgccgttcataatctgagatgccgtcttggtctaaaaagaacaaaaatacgtttacagtgacagtgcttcaaccagtcctcatttttcctcttttttatcttgtttgtcttgacttccagtcaagagtttttaccacagatgcccagctgcaaaaccaggtgtcttctctggctatgtttttaatgctttgtaactttttcttttcaatgctgggataaagggatcgcccacataacaagaggtttctataccagtggcacagttcctgttggttgttgaattgtgcactcattcttgagattttaagtcattaacatcttttgctctagtttgcaaatcaggcagtgtttatgcctgcatcctgacatcagcttttcatatgaggctaagaaccttgattttgatacttcaaactacgtgtttgtctagtttatttgtccacagcatacatcattgttacagttttcatattccctctcccttggggctcccttattcctgccagcatctctttcaggttatttgattacagctttcattgccactgaaaaaataatcaccaacaatgttcaacctgttacaactgccttttctactctctgccattttgtagttttttggcctactgtcaaactcatgaaaatttcaatataatagcctttaaccagctgctgcattctgttaggatttctttcacctttttatgttgcatgctcccatatgggtaaaccaaacagagccaagagctgggactctcttgctttcttaatgagttagaaaattgttcttctgtattctggactgtcaaaagaatttaggaatcccaaacatgcatgcaggatgttccagtatagatgtcataataaaagcataagaaatatcacactgggtcagaccaacagggcaactagcccggaactctgtcccagatgaagataccaatggttgttttgtcaggtaacctagtacattttaccttaaaaattcggatacatcatgaccacttcttaataatgcattgtaaatcaactggcagtgagtttatccaatggtgtcaaacttttcctattccccacttcagctttgtcttaataataatatgttccataaatgtaccgacttctatataaatataggcattttaatttctcttgaatctgcatcctttaacctcaaggaatggccttaattaaattctttgaaattcagtaaaaacatttatatttatccagagtcgactttagcctcacattcccctactaatgcttttcattttcatcttcccagtctgagaaattctaatcctttttagtcttttagtctgtccttgacggaaagataagctttccccttgattatcttagttgtttttccctggatcttttccagctctgttatatcttctttgggatgtcgtgactagggtggcccaaatattggttatgaaatttgttagcattgtctctagtttccactcactcatgaagaaagtaaatgttatttgctgtctcccattggtgcagaaatggagagatcaattgaggtcataacctcttctgcatatattagttctagccgaaggttggttttctgctacttttctgtaataccagcaaaagtgtttgaccttatatttctgccagctgtcccttaggaaggatttgatttttagacaagctggtcctttcctccttcaaagacgctgtggttgctaaatattgggaagaattcactaatgaaactcaggagtaaacctgctgactccatcagcagtaatgcatttcatcaggttccctttcgaaatatctctgaagcccttcacagaagagtgaaagatggggttcttgggaacttgctaactgctcagctttttttacatgcaatgctcaagaagcaactcatgtccaaaggagtgtttatcttttcctgctggtaattttgaatgttgtatatacattgctgtatatgttgcctgatgaccttgatcgacccttctcttcactctcaatctcaggcatgtttccacaaccatttattgcatctgagttttgctcacaactttctgctgcttcctgcttagcaaaatgcgatataaaaccttattggatgaagttaacagttgcttcagtcaacatttcttgttactgttgctgtttgtgctgacaaaattgctgatttgggttctgactgtcctgtcttcttatggcctaccattcctatagctctatttgtacgagtatttgactctctgcctggaactgtggccatctgtctagatttaccttttggtatatgtggctctctgtatcctgttggtctacattctggtttgaactcacggatcttggtctggtttttagtaccagtgttcccctaactccagtagcatctgaatcttgacaccaccttcccctgccccctactgtattgcctctattactactttcatggcaattttttcggattccaaatatgtcccatgcttaaagcatatcttgctctcattcttgttctagcccctgttggtaccaggcattgctccaattcaagttttggttggttgatttcttccttcataatattgattgctatttcagtacctgtatttatatacagagggagcagtgcctaactacatcttagccttaacagcaatcaacgtgttaaatatccctgtgttggctggtttgcagtagacacgtcttctgacaatgagatgggctcttattataaagaaactggagtatgatatcaacatagaaaacatttcctcaggccgggtgcggtggctcacgcctgtaatcccagcactttgggaggctgaggcaggcagatcacgaggtcaggagatggagaccatcctggctaacatggtgaaaccccgtctctactaaaaatacaaaaaattagctgggcgtggtggcgggcgcctgtagtcccagctacttgggaggctgaggcaggagaatggcgtaaacccgggaagcggagcatgcagtggacgagatcgcgccactgcactccagcctgggtgacagagcaagactctgcctcaaaaaaaaaaaaaaaaaaaaatttcctcatttcttattccagacacctcactcttctaagaatgatacaagtcttctgacattgggtttgaaaatcagttgaattttgtcataatctttcatacaatgtgaacacatcatgtagtatataattttgtgctatttctggtaagatccttcttatgtatatttttcttcaaaatataccttttagcagctaagacaacattaaataggggaaattttaaataggctaggcatcgcaagacttgaattctagttccagctttactgtcacctagctattaatacttgaccaatgggaaattgcttattttctgtgggcctcagtttctccctctgtcatttaaggaagcagaatgacatgatatcataggtcatttccagtactaacattttctgattttgtgaatgttgacttcgaaatagaaattgtttgtgatcattttccagagaagtgaaaatgaatcttcatattgcccttgaggattcttattgcaccatcaatcttatcgggatagaaaggacaaataatattaaatgtttcacttaactatttagcactattgatgataagaagtggatgcaacagagaatcagctgtctaatttgatctgtcagtctttgaggatgctggtgaatgattcggggtaattaaatttttgaaatcactgccaaaagcctgatgctctgacttttcaaaaggctttagtacacaaagataacccagaggtcaatcttctctgctgtgttttctcctctgccatttgatggtttcaaaggtcacgttacctgagtctcagtaagctctggaaccacaatgaaggaatagttggtaatacattattgatgatataatcatgaaaacaattcaggttaagatattaactgaaagagagtgaaaggggtgccatagtgttgtgcagagtgctgagtctggttttggttttatagatcttgttgggagatgtagatgttgatatcatctgtgtctcataggttcatgaaaaaaaccctcacatccttttttgtagtttcataagctgatttgtatcaccttgactgaaataacagactccaggaggatagctgttgttatctctttttctagcatagtgcctcacagataacaggtacttggtaaatattggaatgaattcatgaacatatgtcagtaattctatgtgcttttcagtttgctgactcatttcaccttcaaaacaatcttgtagtatttgtgtgtcaatttagatttaccactcaaatccatctctcatgccctctagacatgaactttagtgttaggaagcatgccgagtgtttgatagagtttctcatagctcctacagtttggtgcttaagggacagtccttggcatggatgtatgaatggtacataccaaaacatgagttctagattccgttctatcttaatctaacaatatgataaggagtataacttagctcaacctcaatgagaaggttgaactagataatgcctgggaccactctcagctctagctttgtttcagtagaactagagtctgtttttcctaaatatcattcatgaggcttcttctggttttctagtggtcaatagagctttaaattgatcaactactgtttttcactgagcattgtggacaggacctactttttgggccaggatatagtagccactgagtcttaacagaatgtcatcaatgatacatttttattttacagaaaaatgttgtaacattctatatggcatatgtcatgtggaaaggtggcaacatatatacatacacctatacatgtggcagctaaaatttaatgtgtgtatggggaaaataatcctgtattataatacacatggtatagcattccctgcctcattcgtggcacttttggaaatgtgagaatgagcatagaacatattcaagttggtttatccaaaagaagaggagtaaattatttcagctatttccccattttctttttctaactttcttaaacatgcactttcttacataatcacgtgttagaaaaaaaccagtagtcacatcaaataaatctgcatttgaaacaactgtatcatatcccaactctgttcgtttgagccatttgcttaacgtgacacccattctactttatgacacataaggaatattgcttaagaaatgttaattggctttccttttctcctctgaaactggattgaagtcttattgacctctattagatactgagtgttcaggtttttaggaaaacactcatagagatatagccccagtgtgagctgcatttttagaatattttctagaacccaaatatgtccctaatcaaagttagtttattttcattcttagcgttcccacgtaatttggggtatgtgtgaattcccaaacattcccgggcctctcctaggcttctctaattgcttcttattctgttcccctgggaagcagcatcctgttcccttcacaaaggtcagcagcaacagcccaggcaatgttttaaaataacttaataaccctgaactgcctctctcttctttgggataatttccttagagcattagtcctttgaacactgacctggttgcagaaaatgcccctttctcagtgggaaaactccaaatcccattcagtcttcccctccttccttccaggggatagggtgggggagtagggggtagggagagggtattaaatactttcttcaggaaaaatgttaacacggtaaaacactctctctctctctctctctctctctctctctctctctgtgtatgtattcttttttaaagaaatagactgtgagtgcattgtataaatcagtgctgtcacgttgcaaattttttaaaccgttgtacaagatagaaaaacagtatctctggatattgactctggaaagcttctaagagcaggtcctagatgagacttagctcactgtcggcattcggcaaatgatcacgttttctgtgataccattaactcctggggggatgaaactgaaaagcctcgctgctcttcctgaaactctcaactgcttttttctgtttttctttctcagcttatccacatccatcttggtccccaaagccattgcatgtcagatggtcagtgcaatgtgtaatttttaacttgcttctttgttgctttagaaggaatcgttttgttgttttctttccttttggtcactatttcttgttcatgagttttctgtaaacagtgtgtctcatagataagtccatgtaatctgctagacaggaagaaaagcaaagtttaatgtgtgcctactatgtgctaaatgacaaagtgtttcatctgtatcttcccatttaatccttgtaacactccacttattatccaataaagaaaaaaacggctatcagtcgggcgtggtggctcatgcctgtaatcccagcactttggcaggccaaggtgggtggatcacttgagctcagcagttcaagaccagcctgggcaacatggcgaaaccccatctctaccaaagatacaaaacagtagctgaatgtagtggcatgcacctgtggtcccagctactcaggaggctggggcaggggaatcccttgaaccagggaggcggaggttgcagtgagccgagatcacaccactgcactccagcctgggtgacagagtgagaccccatctcaaaataaataaataaataaaagttaaaaaaaaaaaaaaggaagaaacagctgagattcaaaaaagttggaggcttatccaagtcattctaataaaggggaggggggagaattgatacttaaaatcatcatgataagaaggatagacattggagattcagaagggcagaatgctgggtgaggggtggataatgagacattacttaatgggtacaaggtgcactactttggtgatggatacactaaaagcccaggttcaccactatgcaatacatccctgtaacaaaactgcacttgtacctcagaaatttatacgaataaaaataaataaatcaaataaaataatcatcatcatctcagctattgcttctagctgtttcaactttctaatgtttttgattgaaaactggccatttgtataaccaaatgtggccaatccaccactgtgaggctgccatcttgggcatcaccaaaactactctagtagtccttccctgcactgttaggtggattttccttggcgtatcttcgcaatcaagttgcagagacctaagttactctttgctgctttgggcaataaaggggaacaaaaaacaaaatgaaacaaaaacttggccagccctgatgtaagcactcttctacctccctgcaggctgagaaaacaaagtatttcttttttttttttttaatttttaaaatgtttgattctggtctaaatcaattaaaatgagatctccccccttcttttttctttttttcttctaaaaaaaaaaaacacaccaaaaaaccgagatacatgtgcagaacgtgcaggtttgttacataggtatatgtatgccatggtggtctgctgcacctaatgacccatcgtctaagttccctcccttcaacccccaaaccccaacaggccctggtgtgcattgtttccctctctgtgtccatgtgttcttaatgttcaactctcacttgtgagtgagaacatgcagcgtttggttttctgttcctgtgttagtttgctgaggatgatggcttccagtttcatgtccctgcaaaggacgtgatctcattcctttttatggctgcgtagtattccatggtttatatgtaccacattttctttatccagtctatcattgatgggcatttgggttggttccatgtctttgctattgtaaatagtgctgcaataaacatacatatgcatgtgtctttatagtagaatgatttatattcctttgggtgtatacccagtaatgggatggctgggccaaatggtatttctggttctagatccttgaggaattgccatactgttttccacaatggttgaactaatttacattcccatcaacagttcaaaagcgttcccatttctccacagcctagccagcatctgttgtttcctgactttttaataatcaccattctgactggtgtgagatggtatctcattgtggttttcatttgcatttctctgatgatcagtgatgttgagctttttttcatatgtttgttggccatgtaaatgtcttcttttgagaagtgtctgttcatatcctttgcccactttttgatagggttgtttgtctttttcttgtgaatatgtttaagttccttgtaaattctggatattagacctttgtcagatgggtagattgaaaaaatgttttcccattctgtaggttgcctattcactttgatgatagtttcttttgctgtgcagaagctctttagtttaattagattccatttctcaattttgtcttttgttgcagttgcttttggcgtttttgtcatgaagtctttgcccatgcctatgtcttaaatggtattgcctaggtttccttctagggtttttaggatttggggttttacatttaagtctttaatccatcttgagttaatttttgtgtaagctgtaagggaggggtccagtttctgttttctgcatatggctagagagttttcccagcaccgtttactgaataggagatcctttccccattgcttgtttttgtcaggtttatcaaagatcagatgtttgtagatgtgtggtattatttctgaggtctttcatggataggaagaatcaatatcgtgaaaatggttatactgcccaaagtaatttatagattcaatgctattcccatcaaactaccatgaccttcttcacagaattaaaaaaaaaactgttttaaatttcatgtggaatcaaagaagaccccgtatagccaagacaattctaagcaaaaagaacaaagctagaggcatcacaccacctgaattcaaactatactacaaggctacagtaaccaaaacagcatggtactggtaccaaaacagacatatagaccaatggagcagaaaagcaaaggatttctaagtcatattccaccacctccatcagggcttccctaagatagagagtatggccaagaccatacttaataaatgtcatggaatgtgtttctcttcataccctcaattgtaagtctttctgaaaggtagcgcgtggtcaatttagatggacaagaagtgctctgcaggagcctttgcaacatttgtgcatgtccttgattttgacaccaccccccgccccccattccagaacagatcgtctcatccttcccttaagccagaggcctatggttctagctttactaggcaaatatatatggtctgtggctataagtcacaatttctcccaagccttgagctgggggaatactgagtctgcccatgtattacatgcagaacatttcatcttattgcagaatgatactttattcttattgcagaatgatattcattattgcagagtgatattctttagtctttattttttatcattataactacatggtgcaaaagaagtatttctcatactttttctcataatgactcaaaattacaaaagcaatctgggcaattaatatgtttttgaagataaataatggcttatgttttctgaagattaagaaaaatctctgtctgaatatagctgggcacagtgtctcaagcgtgtaatcccagcactttggggggtcaaagcagaaggaacacttaagcccaggagttcgaagccagcctgagcaacaaaatgatacctggtctctacaaaaaaaaaaaaaaaaaaatccttggcatggtggcatgtgcttgtggtcccaggcacacaggatgctgaggcaggaggattgcttgagcccagggggccgaaagttgaggctatagtgaaccgtgtttgtgccactgcactccagcttgggcaacacagcaagactctgtctctaggaataaaaaaaaaagaagaaagaaaagaaaaatctctatccgaaaaatgtaggcaccctgtgttaatatgtaaatacaagtgctttatcaaataaaggctagattaattgttttttctcgctcttacttatatcaatactacaagaacttttctgccaaaaaaaaaaatcaaataatagaaaagaatgaatcctagatagagcaggaggggctgagcaggcacagcaaaagttcaaggtggaaatatctttatgcatccaattaaaagtaatttgtgtacattttactcatatatctatatgtacacatacatacatacacagacacacacacatatatatatatatatatatggagagagagagagagagagagagagagaggacaacgaagaggaaactaaagagaataaagggtattaacagcaggtctgtgacttattccctgggggatgtgaagggaataaatgaccttaatagaccacttcataaacatgttaatgacctcccagaccttcttgtttatcttgttaatagtggttaactagaggaaagatacctgcaaatccctatctataaaatgattttagtagggtatacctggcctggctagatagcttattgtaaataaacctggaatgtttggatttatgagtcgtggctggctggagaatagggcatagctacatgaacgtttttctatttttgtaattgacagattataaaatggaaaacttttgagactgaaatgatttcctttcaatgtttctgtgtaaatttttaaaaacgtatctgttaatatgaaaccaaagcacatcataatgggaaataacatggatgttttggaaacgcatgtgtgattatttcaggttccccagggaaataatgttctatctgtgcccagcacttccctataattctttcagtcattaataaagattggtactagataagaatctgagatttgtgtgagtctgatgtgagatccaaatgttatacttacacaatttgtgtttattttagtttaaaaattatctttgccatgagcaagaggggaaaaaaaggaggatgagcgggcctacatatttttccttaacatcttgtcccaagttttaggaaatcacaagtctaagaaaaggccagggtcaggactaggaagtgatataacagttatacatgtctacctttaaaattatataagtaataattaatttttaaccttattttaagcagatcctagaaatagcaagagcctctataacgtcccagctaagaccccaagttttctttcttgtttaactcttgaaatattttgttaattttcagatcccttgtctcctcagttcagctgtaaactctctgacaacgcttgtgccttatgcatctttgcatcatccctagcatgtattatatatctcacatgtaaaaataataataaatacttgatcatttgttttgattttgatgattaagcactggaagctgagctatgatcccaataggtatgcttatttaaagaaaaatagatggcagtccaggcgtggtggctcacacctgtaatcctagcactttgggaggctgaggtgggcaaatcacctgaggtcaggagttcaagaccagcctgtccaagatggtgaaccccgtctctactaaaaatacaaaaattagtctggtgtggtggcagatgcctgtaatccccactactcaggaggctgaggcaggagaatcacttgaaccctggaggcagaggttgcagtgagccgagatcgcaccattgcacttcagccagggcgacagagttgagactccatctccaaagaaaaaaaaaatcacacacaaaaaaatagatggcacggcacagcagcttatgcctgcagtcccaacactttgggaagccgaagcaggaagatcacttgagtccaggagtttgagaccaggctgagcaatatagcaagactccatctagaaataaataaataaataaataatttttaaaaaatagacaataacagataaagaagttccatgttatttttttaaattctagatagccccactggtgttacagtttattaaattacatttggaagcgattttttagcagtccatttattttgtatatttcagtttgttgagagcagatggggttgagtgttgatggggttgattgcctggctagattatgctataaactataaatctttgaaagttactgttttgaagaaagcatctttaagtgaatatattccttcagtagctcctattaccaaaactgttgtgagaatatcttaggaaaacaccttaaaatcctcttctatcaaaactcccaagctttcttcaggagccagcattgttcagtgaatgcatgtaagcctatgtcttaatagagggatccctaacctctggaccatggactggaacagcaggaggtgagtggtgagcaagtgaacattactgcctgagctctgcctcctgtcagatcagtcgtggcattagattatcgtaggtgcacaagccctattgtgaactatgtatgcgagggatctaggttgtgacctctttatgagaaactaatgcctgatgatctgaggtggaacggtttcatctcgaaaccatacccccgcccctgcctcccagtctgtggaaaaattgtcttccagaaaactcatgcctggtgccaaaaaggctggggaccactgtcttaatagatcttgaaaaaagttggagtaaggtaagtggtaaatcctaagacatacattgaggcagagctgcagtggtatccagtagggaagaaaagacttcaagtttagaattcagttatactcaaccagtttttgcctttctctgttaaatattagatatcattaccagacacatacaaaagattttaattgcatgaatgcccgatgttgatacaagagagccgatttttttttcacacatagttttttggggtttttttggtagggagaaacatcatctcatgatatcgttttaaaggtgctttattatcaaggaccttagagctttttctctcactcatatttcatatactcttagtcctcaagccatttctttttactgaaagcactatagagtagcaaaaggcatcattatattgctcagcctcattcatcatcaacaaaattgccaattatattccaagtccttgaatgtattgtttaaaaagatgtataaggtgaaaggaagcagttcaatgttgaggtggaagatgaaacatactgactggtagattcagagcatactaatcttgttttcacttgtgaactggaaaaaattaacatggagggatggagaaaacatgttcaaactacaaagtcattttttctgagaagttatctgactgtaactgtaactgtaactataactcagggtatatcagagggctcaaatgtggaacacttctttaaaattaaaacctaaaagtcctgatgtgtaatagaacgtgtaaaaatagcagcctctgaaggatctgagatgagcagaggaacactgaataatataatctgacagtatgggccatacccttacagtagttgccgtggcctggaaactatagaattaattcagtaaaacatcagaaaaaaagcaacataaatataaaatattttaaattaaaaagactgaataagaacagaaaaaaatcccctagcaaatcaatattgcttggggaagcatgaatcccagaccagcaatattttaatccaaataacttttagttccatcgtgaacacctttatcaccaagttttataaagagtggagtgaagaaaaaaagtacttgaggttgttggaaacacttctcaaagttggtggctttattcagagattcatgcttgactgtaccaacttctgtttaatttatacgtagtactttgtcaatttaggaatttggtttacttgtcctttcctaaatatgtgtattacaaaacaaaaaatagagaaatgataaaataattacaaagatgattaagcaatagtgttggctatagtgaacagattattgccattttatagagtaataatatacctaaggaaatctgtgggaaatttaatttgggatataaaacacagaagtcaggcggagatgaaataataaaccaataggaaattaaatttaggcatgagagtccaaagatgtaaattctatagatgttataaaataatatgtatgcccttacataatttcattactctctgaacttcatttctcagtgaaatatggggaaatgatactgaacagtgcagcagctcttccgcttatgaaccaaccagaagatatataaacaactcttaagggttatacattataaagatataatttagtctggatttttttttaaatttgaaaactaattttatataaaccctaattgggcaattctccattctttgacttgaatattatagtaaatatgttttcccaatttccaagtttcatgtattattttcaaagaaaaaagacaaacttttaaatgtccagctacctgggacttcctctgattatcttttaaggtagttcaaatatatacaatttcaaacaacaacaacaacagcaaaaaatattttgccagacaatatgtcttgtttgtttttaatgttcacaatgtaaagtacacttattgccaaacctcactttcaatggtgttacaaattagccaagtataactagtttgtaaatactaataagaaggttgctgaaattcagccctgaatatttcttttctgcaactccaaagaggaaaatttttgaaatgcaaaccttgacctttatcaaagcctaggtgaagtttgttggaggtgtttggttttttgctggtgctttgttataatgcagtttgaaagtagactagattggcaagacataattggctgctgtgtggagaatgcatttggtggaacacgtgagttaggggtgaggaaatatgaagagccagagtggaagcagggagaccagatagtagtgtgggaagcactggtgttagataagatctagataaaggtagcagtggagatcacaagaggtggttggaatcagggaatatggtttagaaacaatcacaggtcttgctgatgcattggaggtcaggagggacagaaagagggcaatccaggtgtctcctcggctttcagcaggaacaggtacttaaagaggaacaaatttggtagggaaaatcaagttttagtgttccattgcagtacatggtaaccatggctaataataatgtctcatatatttcaaaattgctaaaagaatagatttttaatgttctcaccgcaaaaaataaatgatatgttggtgaggtaatggatacgttaattagcttgatcaactctttctacaatatataccaagatcaaaacatcacatcgtatcccataaatatacaaactattatttgtcaattacaaataaatgaaataaataattttttaaagagatgtcttaaagggtggcttgaagagcttctgtgctccaataatacctgcccattagccatactttgcttccagcaacaacaggaaaacatttaatctaaacaaaaaaaaattgcttgtcaactagatagctactcttccgtgtagaaaccctagagctgcctgggtttagacatgtttaagtttgaggtacttattgggtatctagctgtgcagttcaaaatttggatctgaagctaggggaagacgtcaggacaagagctttaacttttgtaatcatcaatatatacatccttcttagagtcatggggtgggatgccatcatattgggatgagggaggaaaccctgggacttcacaatatcgagctagtttctgttttgcaaaaggcaaatgtattaatgaattcattacattaattaagcaaactatatttattgggggctattgtaccagctattgtaaattttatattttatattatatatatatatatataaaatgctcacaaaataaaggaactaagtcataaatatgcatatgatttacataaaggagctaaaataaggatctctgtttctgtttcaattctttattaaagatctatctaagactataaagacatatataacaaggtacaggaggtaaagagtatattcttaggcatctaaaaatttttcctatgcttttgaaatctgtgtgatttactttcttgaattggcctgtaatataggagtacaatatcattgcagagattaattagtgtgtttgtgaactgttctcaaatgctaaaatgaaagcataaaactataaaatggcatcattattccttaaagaagcatagtttccaagggtgtctctgatcattgtcacagcataaatgaccaatttcacccataattagccaagttagtaagaagttattttttactgggtatattttgtttaacctcagttatatttgtaaaagtagaaactgctacttgttactgctttcagaatttctcacaaatgctaaaatgctttttaattctaatgcacttaaatggtttgattctccttacctaagaaaaacatttatctaaagatatactcttgactgattcattcattgattcatttgtcaatagatgtttatttatcagaatatgtgcaccagatacattgctagatgtaaagggtacatttggtgagcaacatgcatgatacctccaaagtatagccagggaatagataatggaaatgacactaagaatgaatacatattaacacaaaaagagagagagagtcatgtgtcaaggcaatttagcaggagggaacttgtcaatacaagggattaaaaggacagcatgactagggctggaggaggtgaggagaaaactcaaaaagtcctctggctgatgcaaatgaattggatgaggagcctatgaatacaaacgtttgaaggttactgatgaaagccaggtgagagaagatgggatttggaccaagatgatgatagtttggatatggtgagaaaggcatagatttgagagatttttaggaggtaaaaatccttaagatttgaggatagatatcataggaggaagggcgcaaagagaaagcaaaacatgtcaaggaatcacacctagatttctgggcaatgcacagttggtaattctttacagtgagttagggaactctaaagaaagatcagatttagggtggcaatttgattgtaaatgtttggatttcaaatgattggtgacatccaaaaagcactgtaaatagacagatagtgtgcacctaaagaaagaaggaggcgcatctgggttggagtcactaatttacatattacttgtatatagctagtaactgaaaccatgagtgtgaatgagattctgatgctaaattctggaaggtcactttttaaagtgttttgctttttgaagtacaggtgcaatactaaaaataaaaaagactaatttttaaaaattaaattaaaatgaaaagcctggaaagataaacaccaaagttatgatactagttgtagtatgggagagggggcatcagagaggatcggaatttcatcttgaatggtgtattttatttcaaaagaagctttgagcaaagataaaatgttaattctgagcattagaaggaacacatttgtttttttgtactgtggatctttttgtatttcctagaactcttaatctaaatcaaatattgcaaaatatatcactgtaaacaactggttggtcactagctttttaaatactttgtagcaacttggttgcttgtcagaggtcttctttgagtgaagtctttaatttatagttctttatgcttgatcagcataattgcaccaaactgttacttaatctgaaaaatagctgtttcctagagccctacttaatactgaaaacctactgtgtttgtattgcaattgcatttttttttttacttttccccctgcttttcagtttgtataatttctgttaccctatattcaagttcactggttctttccttgtctttgttgaatctacagatgagcccatctaaggtatttttcttttctgttactgcttttaatttctagcatttccatttgattcacttatagtttccagctctatactgaaatatactgaaatatagagctggaaactataagagtgaatcaaatctaatcttgcatattgtcttctaatcttacatattttctatctaatcttgcatattgtctttcttttccctcaagagtctttaaaatattaattatggttattttaaatttcctgtctgatagttccaacaactgttacatatctaagtctggttctgattcttgctttgtctccttagactgtgatttttcttgcttaggcatgctttgtatctcaggggtaaaagtcaggcatcttagatagcgtaatagatactgaggtaaataaacctttgacatggtaatttatcttaatctgactgggaattgggctgtgtttgatgttggtagttgctttggttgtcattgttgagttttgttgctgctgtggccaccagagacttcaaattcctctggtaactttgtttcctcattggaagcttgttagtgtagtggttgagtgtcgggcagaggcattctctaatgtttgaattaatacacagttggcctgggtcttggggatgtggtctttacaattatttctttcccttcctccagaggtagagtaacttcaacctcccattcccttcctggagctgcagtggatatccaccagtgttctcagtctatggccccaaggccctttctcctgcataaggctgaaaaacaacaacaacaacaaacaaacaaaaaaaaacaaacaaaaaaagaacaaaacaaaaccacacatagatgagatctggtgttcccttcccctaaaatgcagtggtatttcctcagtgcctgatatggtttggttctgtgtctccacccaaatgtcatgtcaaattgtaatccccacatgttggaggaggggcctgatgggaggtgaatgaatcatgggggcagatttctccgttgctgtacttgtgatagtgagtgagttctcaagagatctagttatttgagagtatgtaggactttccccttcactgtgtctatcctgctgctgtgtgaagatgtgcttgcttcccctttgccttctgccatgattttaagcttcctgagggctccccagccatgcctcctatacagcctgcagaactgtgagtcaattaaacctctttgctttataaactacccagtcacgggtagttctttatagcaatgtgatgtcttttcctctgaagagaagggtataagcagattcatggtgactagctactgtgacccttccccaatcagcaacacagagggtgttggggaggctttctccagattcttcgcatcctccttgtgaaggcaaggtacagttcctgaaggaagaagcttgcaaaaggttgggactccacctatggcagtagcccccaggatcttcacactctcaggctagctcccacatgtcccccaacaatttaatctccctactagtttatatggcatctgctccagggatccaaatgctcaggcactgcttctggctaaaggccaatctctctccagatttcaggttgttctataatgtcatttctctgatggactgatgaaaagtcattaatttatctgtccagcagttttcttgctacaagtatgggagcaacctctttgcagctctccatctccatctccaagttgaaactggaagtctgagcaatacattttagaaattaatatttgtaagttttccgtgtcataacaaaaataataaatgttcactgtggaaaacatagaaaaagattaaaaatatttaagtgcccatcaccacctagacaactgcaatgaacatgttggtaatgtcttcttccagttttttaaaatctgctgataaaatacaaaagatattgtttatataactttgtatcctaccttttcttgagcaatgcaagtttaaacctaaatacgaagatactctaacttcctactttacatttttgacggcagatgtcagctgtcttcccaagtgcagtacccttggcttaatatcaggtagacaaataaggccaccacaaattcacctttcacctcaataacacaggtaatttgatagttctacagaccctataatattacttgactgaagacccagaatacaagtctttcaaggattactctagaaactatataaagtattggtatcatctcccttcatcatatcttgccaaatccaacaggtttggaacttctgtaggaagatttttgtaacatgaaaaatgcgtgttgcaccttccatatccagcaaatacaccatcggttttttgttggctgcaccaatgacataaaatgatttcactgaatagggggtgacccagaatggaaatgtagagcatcgaaaataaaatcaaccgacgcagtctttgcagcaaaccatgtggaaacaaatttaaatatggaacatactctttccaactcatcttcagatgttgctttaaaatttgtgcaggtgaaaaaaaaatctttattttaaggtaactcaatcttttaccattggagagaatagaattatttttgtttcctcttgtatattcccagttgtttaaatgttctctgtttccttgtgtggacacataaatccaaatatatctaatatcaaggtatttaccatatgcagcactttttcctcagatagttattttttgaaatattcaaatagcttacctgtatcatcccccccatccttttttttttttttttttttttttaagacggagtcttcctctgtcaccaggctggagtgcagtggtgcgatctcggctcactgcaacctccacctcccaggttcaagcgattctcctgcctcagcctcccaagtagctgggactacagttgcatgccaccatacccagctaatttttgtatttttagtagagacagggtttcaccaatttggccaggatggtcttgatctcttgacctcatgatccacccacctcagcgtcccaaagtgctgggattacaggcgtgagccatcacacccagcctaccctattttctaaacgaacaattagttgacttttcttcagttcttactcagaaatatctgaccctaggttccaacttttgttttgctctttgcagttagtttttatgtgtactgttagggagatgtgctttttttttaccttcaaatttaaaagagagagttttcaattccttttaagtcaaaatacaactgttctactctaaagctttctttaaaaaaagaaaagtaccaaatcctcatccgtagtaattaattttgacagtgtaggctcagtagtgattcacaaacctgtattttgtgcatcagcattccttattattctaattaaagtggaacattgtgccctcgctaatcattaatgggttttcattttgtaaatgacatttgcagaagttaaaacagcgagttcatgtgaagtccacaggcaacggtgttgaaattagcatcaccatagcaacagtcttccatcattagcattcagggcaacaggaggtgttttgttgtgttttgtttcccaaaaaaagaaaaagaaaaaaacttcaaaggtaaagcctacagaaactctctcagaagatatttatgttccttgtgtgtatgtgtactgtactagacctctaagtctacatagaattttttttaaaaattgcaatgtggatcatctcctttccagatttgtgttttgcctagtatactagctaaatttcatgatctttctccagctgtacacgtctgacctgctgagcagcatttactcattgccaacctgctgctcaccaatagggtttcctacgtggatgaagagagtctgtattcatgaaaatatttggttcaatctaaaagtattatgtgtattcatgagtttttaatttaattcatggaaaatagatttatgctgttagatcctctggtgaactcatttagtcatgttgtagatataggtcaatgattattctcattcatgtttagacggaattaaagaggagtcaaatagagaacaatattatcttaactgagtctctggcagtggtattaccactattactctgtatgtgtgtgtgtgtatgtgtgtgtgtgtgtgtgtgtatgtgtgtgtgtgtgtgtgtttgaattctaatattctgggaaactttaaaagtggcatatctagcacttatgtttttctcagtactaaaatgcataaaagagcaccatattgacctaccagctgcttctaaatcacaccagtagtaggtaattatgaaattcaaatgaagtttaattttcatttattatacaaaaatgtcatagctcaaacccagaagtgttacccccaagcttggatatagacaggtatgtgtgtacattttacttttcaagatgaatcatagcagtcttctccattacatgtaaggactagaagttgtacattccactcaggtacctaaaggcaagcctgtgctagcccacactaacaaagcaaaatgaagcaaaggatctatctggctttcaatcagggatgcatctatgctatcatcagctctgtcacataataaatgagtctatagataacttgaactactcagccaatgggctgtaacccagtgattctgtggtattgaaaggcagcaacccccagaagccacatgtctcagtgtgcactccaggactgtaggcccatagaacttgtatgtatgcacacatgcatatgcattccccacttttctaatggcgatccaatctaggcctaatccacagctagtccagaaaagaacttttttaggttttctgtctgccatcactttgttgagaggcagtacaagccaagcaggtgtctgtatttataatatgcacaatgttaggataactcaaactcataagggaaagattaatggctgactactatgaaaaccgcttctagccttgtgataccagcacctactatcttcctttttctcttatatgatgaaaagatttcaatgttggcttttcattctgatagaatgtgcaagccaaaatctaaataaagtccagtggcaatgatccccttaaacattatatctttcttctcgatatgctgatgttttcccttataaaaatctatgtaagtttcaagatttatatgacagacaaaccacacaaacaggaggtccctcacattcactactagtcacttgctctatcactctgggaatagcggtcttcagattgcatctctactctacctcttgctcttttcaacccctctcctcttttttagaccatacagggcatcagacaaggtttagtttaccactaaactttgggatttggaagatggtgtataaactgatacaggtagtccactcacagatgtagtatataattacagacttgagttttcaggggctcttctccagtttcctgtcaatcaatttccctggctgagacattagcatttgtcagtgaccatgcttactatatacatacacaattgtgtatacacaattgtaaaattaaatacgggctttagaagagattattttttcttaagagtaggttactctataaatgccaaagcatgtgttatgacatagaaattcaaatgactaagaatagctaattgtttagaaacatcttacttgatgtctattgttccaaaatttgatccaatttagagtggtaccaatccatggtgtagaatataaaagctaaaggataacaaaaatcctaggaatctcatgccagtaagaaagttctaccagtcagatgagatgttgagagcatttatgacttggcatcaggaatattataagtaaaattcatgtgagcagtaattgcagctatgaaccatgttatttgttcccacttgtccaactgtaattctttcacttagctcagagtagttctttgtaacattagggcccactcatctgcctttaggtagggttttaaaagatgcctagaaaatagttctgtgctagaaatcagagactcttgacctactgtaaagggagcagtaagcacgtttcctcaggagaatctttctacatactgcagattcccataaaaatctttgtgacaaaattgcctttactgaaaccatcatccattggattaaaaaatagcttaccattagctttttgaaaatagaaaacgttgagccttttcaatgatactttcaatagtttttcacaactatgagtcctcaagctatcagtcttatttttagataccatacttataagatagttatagaatttatagagtatggtttaaaagactattcaattatagagcaatcattcagtttattcccatggcagaagtaaatggaaaccactccagatcaacaagaatctactctcttctgattcagaaaagagatttcctatcttttcatgaataatccatgttcaatgtttaacacctcaggaagattttcttaatagcttcttctggtcataaatccttggtctgtcatcagggacatattgaagagttagttaccaaagttcttaatgtctcccattgtaaaaaaaaaaaaaaaaaaaagtcactttttggattgtttctttcatagagtccatgcttctgtacgcttaatactttagcttttgacttcaagctttaggtaatgcaaatgaagctattacatcaccaaagttaaatttttcttgtaagtatattctcaacattcacaattgagagctgcctcttctttggctggtataaggttttaatttattgtagcactttcaccctagaatggcaaaaaatgttgaaatcaattccatatatcaccaatacaaagtactaagtcaaggccgggtgtggtggctacgcctgtaatgcaagcactttgggaggccaaggcgggcagatcacttgatgtcaggagttcgagaccagcctgaccaacatggtgaaaccccatctctactaaaaatacaaacattagccaggcgttcatagcgagcgcttgtaatcccagctacttgggaggctgaggcaggagaatcgcttggacttgggaggtggaggttgcagtgagccaagatcatgccattgcactctagcctgggtgacagagcgagtctcaacaaacaaacaaacaaaaatattgaattgtacaccttaaatgggcgaatcgtatggtatgtatactaaatgtcaataaagctgttatatgaaaaaaaaatgctaacacacacattctgaaagtatattaaaagcaaacctacggccgggcgcggtggctcacacctgtaatcccagcactttgtgaggccgaggtgggcggatcacaaggtcgggagatcgagatcatcctggctaacacggtgaaacccagtctctactaaaaatacaaaaaattagccaggtgtggtggtggacgcctgtagtcccagatactcgggaggctgaggcaggagaatggcgtgaacccggggctggagcttgcagtgagccgagatcgcgctactgcactacagcctgggcaacagagtgagactccatctcaaaagaaaaaataaaaataaaaaagcaaacctacaatgtctcttacaaacacaggcaactattcaattccgagtttacactactgaaacacacatgaatatgacactaagagaatcacgtggatctgcactcttcaatcaacactacgtctctgagcacaagaattttacatctgatttccatttggggaaatagattcagaatgccataaaccagatacttcttgccttcctttagtggtcatttctgccattatcatttaagggaatggatctccttctcccaaaactgttaccctaagattacaagcttgtcctttaacttatctctgaaagcacacctctataacgggtcatcagtattcagtcagctaattagactgcagaagtacgtttactcaaatgtgaggagataaaattgtgaaatgtaagaggaagaaagaatgtcaaagataatccaacccaaactcttcatcttacagataggaaaatggaagtccaaaaggggaaagtaattttagtaacatggctaaactggtctagaaaaccagatcttctgatacctgatcccatggtctttctaatgccatggatgttcgggtagaggatatattcaggtagataacttatagatagccccatgtgtttgtatagcactttatcgaacactttcacctctattatcacacttgattcttacaatatcccatggaatgtttgagtatcatatatgattattcttattcccacagacttggaaactgaggctttgagatgtctggatctatcttagatcatttgctatggactagaatctgggactaagttgcttttgtctaagctgtgtgtttgttctgttgtgccgtattgttaattcatttctgttggtaaacaacacaaaggaaaaacttctataattatgtttctttttcatcctcaggtcatctatcctactttttatctaagctttggaaaatattatgtgctttccttttttttgtattttcttttcgtagagatggcagcagggggtagtctcaccatgttgcccaggctgacctcgaactccttggctcaagcgatcctcctgccttggcatcccaaagtgctgggattacaggcgtgagccaccacacctggcctattatgtcctttctttagcttgctcgtttaaccatttgtttggcagggggagtcagaactgtgttttacttagtcgattaactgataggacaatttaatatctaccctgcactggcagtaacccccatagccccgctctgtgtctcattctgtgccctgaacaaccttgtcttaaaaacattttaaaagcagcaagtatggggagatttcttatctccatataatacagaagcaagtgtagagtatggctacggaaaacaaccagcaggtgaggctgtgacataacaattttaacccaagcctcactgccacattgaggtatccttgttcaataaatagatcagaaaatatggtgtagtttttccctaacgctgtctaaacagcaacaacaaaaaatcattacccatagtatttcagtaatgtgttgtattgaatgcattgttttcgagggcgttttcaaaaaataagttgattgaatctcttttttttgcttgaagaatgacccacattcagaaagtatacagatgaaacatgttcagctcaatgcaattatcacaaaatgaatacacctatgttcgccatctaggacagtaaataaaacattatcagtagccctaaaccagattacacacacacacacacacacacacacacacacacacacacactaaaccagactacacacacacacacacacacacacacacaccgggttgggggagtggtgagagagagagagagaaagcgaatattatgttaacagttggggagtctaagtgaatggtttatgggtgttcttttaacatttcaattggtttaaaattttcaaaatgaaaagcttgaggagaaacatagaatataaccactacctcagaaatcaccaccctacctcacccacattccctctcccaatcactattcctccctcatcttaaaggtaactgctactctgccttataacactatggttgagttttgcctgtttatttgaactctataaaaatggaattgtacagtatataaccttttgtatctaggactcaacattgtgtttatgagattaactcatgttgttgcatgaatctgtcatacattttcattgcaatttgatatcccatttaaaatgtatactataatttatccattctattgttggggaacattttggttctttccagtttgaagacattatgaataaggcctcctatgaacattctttaatgcgttttttggcacacacgtgtgtacaactgtgtttggtatatactttgcagtaaaattgcctatgttgagggtaggcatatgctgagctttagtagatactcctggttttccaaagtggttgtaccagtttacaccatcattagcagtatatgaaagttctagtagctccacatctcaacaatacttgatacttgttagtctttaaaattttcgccattgcagtgagtgtgtgagtagaatctcattgttattttaatttgcaattgtctgattacttatgaggttgaatatttttacgtgtatttattgaccattttggatatcctgttgtgtgaagtatctattcagtctcttgcctattttttttattgattcatccttctttttcttattgatctgtaggagttttttttacatattctagtttgtagccctttgtaaattgtatgtgttgcaaatatcttctcccattttatagctttccttttaattaaattgtttttttgattgatagttcttaactttaatatagtccaatatgtaaatttttccttagggttaattcttttgtgtcctctttaagaaatctttcctaatacaagataatgaatgtatcctcttttattatcttctagaaacttactattttttaacttttccatttagatatatagtacacctggaattgaccttttgtgtaatatgtgagatagagattgagttttatttttcataatatggatatctagttggcccagtacttgatgctaaacattcatttagaattcatttgatagtatttcctttagagttattgcatctgtgtttattagttatattggtctgccattcttgtcaaggtttggtatgtggattattctggtttcataaaggcaagtagggaagcattgcctcttctagtctctggaagagtttctttaagattggtatttctgccagtgatatgatttggccttggaattttcctagtgggaaaatttataattacagtgtttatttcttaaatagtacagggctattccaattttctatttcttcttttgtcagtgtcagttgacttaaagcacactaagatactctaagattgctatggtcagcctttgctggtctaaaccagaggttgcaaactgaaatgccaacagaggggctagcctgctactgtaactgggcaaggctagcgaagcgtaagttaatgggagctggtagggactatagaatacatgtgccgttatagaatggtggctccggaaagttattgtcatgcaagaataggagcccagcatggacaaatcattccttttaaatgagaagtcagaaggttggattattctgtaaaatatctctgaatatttaaatgttgagtaattcagattaaaaaaaaaaaaactgtgtgggctaatcaaaacatttgtgcatgccaaatttagcccaaagtctgctagtttgcaacttgtactttcaactaatgaaaagcgtaatagcacagatataattccattttcaaataatataattcatttatagttgacatttatttaatttacacttaaatatgaatttgtcatttaatttaccatattaaaaaagtttagattttaagacatccaagtctgcaaataactagaatattttcatttactctcatgtttgtgtacttatttttccttaaatgttattttcatgatatacttagtgtcttgtggacattccaaaaaactgatttgacttaaattgtcctcactccaagctttaaaattgcttagttcatagcctaccttgcctaaagcaaacctggtagtctcatttcaagttactggattttttgtttgtttgtttgtttgcttttgccttgtttcttttcaaggttatatagagtgaaggaatatcagacttcttttaatttttgcagggaattcagattgctgtggattaagatcctatatataagatgcttaggatagaggcatcatgaatgaaaaattattcatatgaacacactttttagagtattatttttattcattcagcaaataatcatagctgccatactaggcaggtagggaccatgaagactactgtccttgtagtctaaagtcttgtagactaataagatatgtataactgttaaatagtacactgaaaatacaaccttaaacaatcaaaatatttgcaaattgtatttagttgacatgattgcataattgtatttatgtgacaattatatttgttattcacatatttagggagtcaatatgtacttaaggtaatctttgagctattttcaggatgaggtattagctcattactattaatactaccatcaccaaatgcattacctacttatctgcatttccaggaaaaattcaggaaattaggatttttaaaataataaaataatagtaaataagactgggcatggtggctcatgcctgtagtcctagcactttgggaggccgaggcgggtagattgcttgatgccaggagttcaagaccagcctggccaacatggctaaaccccatctctactaaaaatataaaaatcagccaggcatggtggcgtgcacctgtaatcccagctactcgggaggctgaggcatgagaattgcttgaacccaggaggcggaggttgcagtgagcagagatcatgccactgcactccagcctgggcgacagagtgagactctgtctcaaataataataataataataataataataataataataaacagaataataacctaagtgactatatttgatatatagttaagtgatgtttttgtagactttactaaactaaaaaataaattagcagttatttaattttctagtttataaagtacctacttacataaagttgcatatattacttcatttaattttaaaagaatatcgtaaaatatgtaggatagatttccattttatagtcaacaatacttattatttcaatacattatgtgattttttttcccccagtatcacagtgttagagcccaggttcaaaccagcattttctaactgtaagtctggaagtctgtctgcttactctatgtaagatgccttatgaagttcatagaggagacagctcagtggattcaggcctggtcttatattttgctgttcatcttgttttaagtgttatgttaagcaaataaaacataactttaaacattctgtttacttttaaaatttgatttagagctaacaaaaattagaatttgtactccatttacaacgaacagaacaaccaaataagcaaaattgtatttgcgttgtcaattacaataaataattataatggtatatcagagtgttaaattttgatttttttttttttgagatggattttattttattttttattttttttttttttgctctgtcacccaggctggagtgcagtggactgcaacctccacctgctgggttcaagtgattctcccgcctcagcctctcgagtggctgggattacaggcacccgccatcatgcccagctaatttttgtatttttatagagatagagtttcaccatgttggccaggttggtctcaaactcctggccttagatgatccacccgcctcgacctcccaacgtgccaggattacagatgtgagccgccacacctagactaaaattttatgttcttatatttctttaaggaaagcaaaaatgttgacagagagggttaatactagttatatatacaaaaaacctaaaaataagattttggattattctattatatgattattcatttattgaaaatcataaactaattgaatgactgagagcagcactaatgtgattactttggtaggaatctgtcctccaaagttgtcagttgtcagttattcttagcattttgaactgaagtctatgtaattaagtcacctgttgtttctgacaaaatgagcaaacacacataaaatctcttggttcgtcttcatgtctctgtggcagagaactgaccacattattcagttcctttgtcctttttagacaaaagccacctctacatggccctataagtcttcaattcaaggactatagccgttatcttaatgggattgtacttggttatctgataaattgtcgggaacatacccacattgcttcctttacctgacataaaatttagtcagctggggctcaacgattgaccagctttatcttgcacgtagtgaagggaaggactttcttactcctggatgtgcctaaatttaagcctttgaaaaagattgaagataccaattggcctacctgccctaagtagatgcttcccacagacttaactggtgaagtgcttgtctaaggtagacagaattttttctttagagaggagcaaacaaaaacccaaaaatactggcgtgttcttttgatgttctatttcccaattgatttccgggttcacactactccacaacatcttactgtcccattgcatcttaaccctctctcctctcccgcccccactttttttttgtctgtttcttctgcttccaccgttgcttctgctctgaagcaatcattttctctcccttcaaccaagggtggaattggcacacagtcaattggcttgggagactgcttactgatctgtcttttttgaacactggaatcttgacactggttatcattttgaggacagcctggtttggatatttatctattaagaggaatccttaattggtgtctttgactggagtatttgaaggagtctttaattgggaggttttaaggcaccagaaaagattcattaggaatgactgacctcatgttatataaatgagaaatatttaccatttgctgtacacgtaattgaagcatgattatacataaaagcatataattaaaaaatgtaaataaatacctaaataaataaatgcctataactagcatggcaaaggattctgatatcagctttcaatctcttttagtagagactggacaaatcagaaaaagaggatttatacctgtcctcctatagattatgctttcttctcccatcatccagttttaattgaatctcctcattgtgctttctttcaatcttgagctgcacaagttgttttctcctgtcagagcttttaatacacattgacaagaattattagtctctatctgcagttgttccaagtgcaggtttgaaataaggagtcgtcatcaatgtgctaacgcgtgctacttttggtatttatacaaagtgcctgctgccagttacttgccacttagaatgtgtttttcttttcctctcttgcgttgtgggagtagaaggattctctgtttcttttggcagacagagaaattttcagattggggtctaatgaaagaaataggttccattatacagatgtacagatgttctaaggtcacgatacctcctataatattcttatgtgaaacctcctctttatgttcaacctgtgtacgttacacttatacatagcaggcatagtagccatcaatattagttactttaaaacccaggcctcctaggctgtggtttgtactaaaacatcatattcaaataaaagcattccaatacaaagtggagaaacagggacaggcatggtggcttaagcctgtaatcccaacaggctttgggaggccgaggagggcagatcgcttaatcccaggaggtttagaccagcctggccaacatggcgaaacctgtctctactaaaaatacaaaacttagccgggcatggcggcacatgcctgtaatcccagctgtaatcccaggctgagttatgagaatcacttgaacatgggaggcggaggttgcagtgagccgagatcacgccgctgcactccagctttggtaagcctcggtaacagagtgagactctgtctcaaaaaaaagaaagaaaaaacgtgtagaaagaaagagaggatctgattaagctcacaggaacattgcttctcaaattttaatgtgcatacaaattgtctgggaatcttgttaaaatccagattatgagccagtgggtctaaaatgagacatgatgttctgcatttctaacaggtgatgctaatgctgctaatctgtggaccaaccacactttgagaaggaaggaagtagactattatatttactcattcacttgttccatgataactcttaaaacagactggtgactttaatacaattcagagcaccaaataaagattgtcatatgccttatttttaacctatcgtcttatatcaaaattatctgataaacttcccaagtgtgcatatatattgtcattttaaataggtttcaataaaatgaagattcgtgagtaagaatataggaataaatgacattaaaatctttctttataatttatatttctactttcttttgaaagaatttgtagtggcttaaacataagagcacaagatgagccagtgacaggaaaaaccaagtgcatctgacatcttagcttattaggtctagaagacaacctccattacttggtagcaagcggctgggaatattggtgttcaaagctgtgctttcctgaaggcaaaaacagcatcaaaatatgaaaagctttttacttctggcatgagtgataaagatgccgatctgagaagcaggtgaaaaaacttagcttatgcttctaaaggctaattttatataagtgttcttgtccagctgttcttggtaagtccagctgctagttgaacaggacaggtggtaatccctgttcagtggctcattatcacccagaggctttgatctggctaatacataatcaatcagcttctgaatattaatattcttcctattttcatttcacttgttttacctaaatttattttccaaagttccagtatgtttttgttttttaataagatttttgatcatttatttattttgacataactaggctcatgatatgccagctggagtttattacacccctgaatcacaaactttttttcttccctctttatctccttacaagatccaaattgcaaaacctaaggataaagttctaattttggaagcacaaaagactgaaactattttagaggagagcgttaatgaaaatcaatatctaaaatcctcattttaagactgtgaaccctatagtctatacttctagtgtcttcagagttgtgatatgcatacattaaggactaagaaacatttttttaaatagtcagatttgggagcattagatatgtttgtagagggaaaaatcaatttatgataaaaattactgacaatggtttaatttgtattagttttgcccacttccctgttatctcagaatggcacctccatggacagtggaatggtcctaacagcctaaatatggtaagctttaaaaacagatggcttggggccattctgcttattatatcattgctttcaatagcataactgttcttctccaatggccctctttgttgtttgcttcattactggcacatttctttaatatgtaatctataacattaacatgaaaatggctctcaaatactattactttctccatctgtgacccagtactgtttatcatcatctaatgatcattcttattgcagatggccctctttaaatgtttcagaatagcattttaaagacattgagggtgcttcctacgtacattggcagactgaatgttttaatatcgaaaatctcggtctacacgatgtgtgataaatgactggagatgcaaggcaccagtcagttccaaagcaaggtgtaagagggacaggaggagagtgataaaaaagaatacatactttgcgtgtgtgggtgtgggtgtgtgtgtgtgtgtgtgtgtgtgtgtgtgtgtgtgtttaagccattagatttatctttaaggaagcattatctttaaggaaagttggagtaggaagaacaaaatttaatcaaaagaaacagttcttggccagaggaggtggctaatgccggttatccgaacactttgggaggctgaggtgggagcattgcttgaggccagcagttcaagacctgcctagtcaaggtagcgagacaccccacctctgccaaaaaaaagaagaagaagaagaagaagaagaagaagaagaagaagaagaagaagaaacagttcgttattgcagttcttaaagaaggagtttgtgtttcctttctgatcattcaccatggcagtgatacaaaggagtgatatcaaattgataaatgagttccctaaggctcaacatatactaaatgcctatgctgaacttccaggtttcaagtccctagagcctctctgtctgaagatcctatcaccaaggattctttgtcttcatctagtactttctttctcctctctctattctttcctcatttgcggatgcttgctggggcctgtcaatcaaacatagatgatccctgacttacaatggttggatttaggatttttttacttgataatgctgcaaaagtgatacacattcagtagaaaccatacttcaggtatccacacaacccctctgtttttcactttcagtacagtattcaataaattacatgagctattcaatgctttagtataaaataggctttgtgttagatgattttgcccaactgtaggctaacgtaagtgttctgagtaagtttaaggtaggctaggctgagctatgatgttgagtagattaggtatgttaaatgcatttttgacttagaatattttcaacttatgatgagtttattggtacataacctcattgtaagttgaagagcatctgtatctgggttggagcagaagtattgctagtaatgcatccatgagtcaactgtttgcttaattggtatgctaccacacatgtcttgagcttgttcatcccatggcttgccattgtgttggaaaggaaggtgttacagcattgccgttaataacatttctaaatgggaccaaaaacagtattttctttatctgctagatctttttattttcttctttctctgtatacgtgagctgttcccaaaatttagcacacatgttttatgattctcaacataacgtttatggtccttaacattaatctcatattagaaaataaatcatgatgaaggtgaaatatagaccaagcaggggcagttatgaggaccaaatcgtcagtataaaacttttataattaatattttcatgaattgatagcacttgcttcagagagctaaactcagaaaaaagagaaatattctaacctgaaaatatatttttaaaaactcataatttaaggtagggggcaagtagatttggccatattttgggctttcttcaccaattcagacacgataatgactacatttgtatcctagatttaaatttgctagatggaaaagaaacacataaatataaaccccatctgcgcaaacaaacataaccattcacattcttatgcaggattctggggtaggggagggctttttttgtattataacatagcatgttaatttttaagataaaatggaaatatttttgtgcttttgttaatttttatgttaaaaatgacattttaggcacctaatcaaattctctgagttctttcactaaagaattttgcctaatatttgattaaattcattattattaaagatcaatggaatttctttcagtttgaaaagttgaaaaaatgagttgacacattgattcatagaaaaagttatgaaatttgagaaaaattattgaaccaattttatttaaaatacatatagatattatgtgtatctgccttcattttcaggataatgaatgtcagtgttaaatgtggaaacattctaaaattggaaatcagactccacttggttcaaagaacaccttattttagataagccttttaaaataatgattgaaatccagtcaatccataccctcacacataatcctcatgcatgatctttgtttttccctatctctcctctaaatgtcctttacaaagatgagaaatgttcttcccaacacaaaattcctttgattgtatattagaaagaactgacactttgcagcaaggtttaggaaaagctaacgtaagtagagcttctctgaaaactgttttaccaaaacatactggatttactgctgttaaataatggatttttttttttttactatttatatttgctcctcattgaaacttgtaaatgactttattagtcttaggcaacacatttcattttgcattggataaagatgcttcttcagtaaagtgttcatttatagcattgagaatcttgaaatataaccggtgtcatcaaagggtaggaaggtagaggcacagagaagtgattaatcacttttccctccaatgaatgatctactgtcaagttcaataatcatatttcatctataaagagcactttgagcaaagcctgttttgcacacgtcattacatttgattacaattaagtataaatatatgcctattatttagctctagttaaaatctgcaaaaatatagaaggcttgtgggtgatgtaaattggagatttgcataggtttagggtacaatattagaaaacactgtagttttatttttgctttatgactaaaaggcactagctatgttatctcgtttgttcaccaaactaaaaaacaacagctaaaaagcaatgtaacaaatttcctctaaccttcttaacccatccactgctgtcgcatgactctcacaaatcagaaataaagaaccatttctctactgaaggtcatcaactcatttgagggccatagatcagtaaaaaataacttagtctgagacattcaaatcacttgctttttaggtaaatattttggcttttaaaatgacacaaatctgaccaaaatgttactcagctttatgggaacgggattcttttctagataatcttagggacgatcttaactcatattgtttttgttcagagactaggtctaatttgttagaagtgctgccatgggatctcattctactcaacaggagtgcattcttcttatccagtatccactaaaagtcactcctcctcccatgaaaagagttgccagtggaaaactcagagaaaacatgggaagggattggtgatgtcatataaggagattagaaaacatttttttaacgtttaaaaagtaaagagatgaattttaaaatttacaaaccaataagtttgatgttgatgagcaacaaaatcctggaaaatgacatcgtactgattattaatgattacataggataacatgctgctgggaatcagcgtgatactctcaaaatctgccatgtcacatgcacctcattttcattttttttatggctgcttgatggttagatgagaagactgttagagacagcataacttaggattttacaccacatttttcaagttctcttttgagaatattgggtacaagataaagaacagtggggctggctaataggctgaatttgaagctgattaaataatgacatctaaagaatgtcaattaatagatctagatcaacacaaaatagagtctctgtcgttggccctgcctttgcacatggctgtttcttcttcagtcatctcttaagctcaactcagccctctgcctgaagacctcatttggccagttttgcccattcattactactgtgaactctcttttgttatttttttcctgttttattctgagaatggattgagctagatatgtggaagttatgggaaagcatattttaactaaatattaaagaaacttttgtaatcgagctctccaaaaaataaaatccgccactttgaaaagcattaaactccctgtacagtagattttcaagactgaaatgactgtctcacccctaaaggcaatttctgtattggatgagaggatataattcattaacctttaaggtcacttgtgaatctaatgttttgatattttcggaattaatcagaagggaactgacagcatgacctgaatctgtcctatatttatgtaaacatcctgtgtgatgcacctcattctttgtgcagttgtatgcatttttgaatgttaaatttgattttagggcaaacgcttttttaaaaaaattttaaaataaactttattaaataaaaatttacacacagtaaactgcctccatttaaagtggttcagcgatttttggcagatgtgtacttgtgaaaccaccactgcagtcaaatgacagaacgttcttactcccccaaaagcctccttgtgcccctttgcaggtcatttttcctttcacccctgattctaggcaaccactgatcgtctttctctcactgtgtattactttgcattttcaagaattttctataaatagaatcatacagtatttttgtatgtatctggtctcttatattcagcataatgattttgtttccagcttgaggatattatgaataagactgctaaaaattgtatacttgtttttctaaataccccttataaaatcttacttttgagaagcatattactaaaataacttcccaggttatatgtgtatttgttctttctgttcatttcagcattatcttattaacaagcaactggaggacatgcaccaaggataaattgactaggtgctaactgaatttgtgagaaaggcctagtttctaacgttctttcttgggagcagatgtgtaacagctacttttgctgtataacagaccaaccccaaaacttactggcttaacactgaggtcagcaaacattttctgtaaaggacaacatagtaaacactataggctttgtggagcactttgcatctttgttgcacattctttttctttttacaactctaaaaatgtagtcatacttagctgagaggctgtacagaagcaggccatagaccaaatttgaacaatagttcataaactctataacacaatggccagccatttacttagctcactatttgatgggtggattgggccatttatgtggtgtgaccagttgtactactgtttgccaggcatgcttatgcatctgtagtcagctggcagctggataagctatcgtgacctgactcatatgtctgatggttgacaggctgtcatctaggaacagatgcaactaggtttgtgtgtatctcatcatccaacatgctagttcaggctagttcacatggaaacttctcaggtttctgcttgtgtcatgtttggtagtgtccattagccgaagcaagtcatgtcatagggccatcccagatgtaaggagtggggaaagactccacctgttggtgggaagagatacaaaggcacactgcaagagctggacaccaaggagagggctagaacttttggccatgttgcaagatatcacaaaatattcaagaaaagttacaggaaggttcctctgtggactaaattctcttctgaatttagatgtaggtaaaatggagtgtgctgttaaaattcatgctttgtgagtaatcattgctaggctaaactgtttgtggcttcacagccaatggtagacatacagcatccataatctagtgcttttaaaaatataagaaatactgattacaaacatagttaaccacttattagtactgggaatttaatgaaagctgctgtgattaaatactgaaaaaagaaagattgtgggtttccttctggtaactttcaaagctggtcactcttttgaaaggaattttattcttaaagctgttatttttactcataatatgcttaatacccccatggctgcagactgtctaaaatgttcctacaattatatgagaatacttttaaaaatcatgataattatcagtcttcatggacacttattcagattaatttccccaagcacttaataggatgaatttataagcattaaatagaatggggaccatccagccctaaaatgtgaccattctgtcaggcacacacttgccaatttgttggcgtggacctgagcacactagcaaggactttgaattaggtctcactgcaagatggaagcagaagggcatttctcagtttatgttttgaagtgttttgttcagacaggcaacgtgcagttgtgtatagtagtgtgagctacctgttactccccttaacaatacttttagcagcaatgtttttcctcctgcaatgtgacaatatcaccatgccatttggaagaaaacaaaaaggctgagtgattcctggtatactcccaaacagccacccaaacgaacagctggcagagaagacaccccctaaaacttggagcagattctcagcccctgcagcatctcatgtggttagaacttcagacttgatgaacgcctccccaacttgctccccctcctgaatcttttaatcctcctccagtctcttgtaatgttccagcccttaccagggaataagactgcaaactgtcttccgtcaacttctttccaaatcctagtctagagaaattataatgatgcatgattgtccagtgggcatgtatagtttgtccatttctttatgtagtaaagcctgtagctttcatcttttttgccaatccactataaaaattaattttatatgtcatcctggtacacacacacacgcacacacgcatctatatctgtaaatctttttctgtctattcatgcttgtatgattgaaagaaaagtttcacaaaacattacttacccataccaaatagtacactttcatattttttttttttttttaatttcaacttctattttagatacaggaggtacatgtacaggtttgttacatgggaacattgcatgatgctaaggtgtggggctcatgacctgttacccagattgtgagcatagtacccaataggtagttttataacccattttccccactccaacctctacactgtcatattttctattcttttctgtttcattaagaacaatactggtaatgatccactatatagatttcatgacgtactaagggttcatgacctgcagtttgaaaaacactgtagttagttttatctccacctcaggccaggtcatcagaaagctgcattcttagaccactttgccttggcccccataagattgcctcaactcaggtgtacctcggcatcatgttcctggcttatgtcgaggggcactgaaaactgctgaagggatttttctgaaagtcgacaccatgcagtgtctcccaccttagatcccatgcagatctgtttattcaatctaagtcattccagacttggattttcctttgtttcacttacactctttcctccttatcaataatccaaataataaaatcgatcatatttccttttatattttttcttttgctttgacatctacaaaggccacaaccaaattatacccaccttttaaaacacttttttactgaaatatattaggcatgtagaaaataagggagatgctggttaaaggatatgaaacttcggttaggaggaataagttcaagagctctattgtacaccatggtgactataggtaatgaaaatctagtatagtcttgaaaattgctaagagagtagatttaagtattatcaccataagaaatgataagtatatgaggtaatgcatatgttacttagcttggtttagccattccacagtgtatacatatttcaaaacatgttatacatgataaagatatacaatttttatttgtcaattaaaaaaaaagaaaaaatggcttaaacttatacagttcagtgaattttcacaatctgaacacactcatttaaccagcatccaaataaagaaacagaacattaccaacctttagaaggccctttgtgtgcccttctgatagttacctgtcctccaagggtaaccacaatcttgattttgaacaccattaaatattctggcctgttcttgtcctttatataaatgaaattgcacagcatgtactcttttgtgtctgacttctttaaacctggattcatccatgctgttgtatgaagtggtggattgttcattctaattgctatgtaatatcccattgtgtcaatatcctgcagtatattatatactctactgtggatgggcatttggtagaaaaaaatgatgttataaacattctaagacatgccatttgatgaatatatgtatgcattcctttgaggactatatcaaggggtagaatttctgggttatagggtctgtgtgtgttcagcttctgtacattcttccaaacagttttccaatgtggttgtaccagtttgcactcctactaacagagcatgagagttgtagttgctccacatcctttctaaccctgtgttgtttgtcttgctcattctggtgggtatgcatagcaaaattttcataaccacatcatgcactgtgatcttcaaagctgtgttctggctgggcatggtggctcacacctgtaatccctacactttgggaggccaaggtgggctgatcactagaggtcaggagttcgacaccagcccggccaacatggtgaaaccccgtctctaccaaaaatacaaaaaaattagccgggcgtggtggcaggcacctgtaatcccagctacttgggaggctgaggcacgagaattgcttgaagctgggaggcagagtttgcagtgagccgagatcgtgccactgctctccgacctgggtgacagagtgagactccgtctcaaaacaaaaaacaaaaaacaaatctgtgttctaaattttcctcgcttcttaaagttttatgctatttatatttccttagtgctgggttttattaatttttaagagttatacattgttataagttgccctaaagcctttacagaacaatgcacagtataaatatgtacatagtatatacacaaatatgaatccatgaatgcacagctaatagggccattatcaaaaatcctacacttttccttttcctctagccctcacattcaattggctcaaaagtagcattgattttattctataacctgtcatgaattcagcctctccacaaattcccagtgctcctttcttagttcagactttcatccactcttaactgggctgttgtcatcatctacttggcatacatttccattctgatccctaccctcttttccacccttgtttcttcccacctcaaatttaattctattttaaaaagaaagatattcaaaagtacaggtggtgccaattttttcttctctatccatcatatgcaaagaggcttccaattctttgtcgacctgtttctaagggatgagagtaggtcaagctgtgaggacttcaattcccacgtgaaggtcttgttcatattaactcaataatgtgctttgatgtcctaatggggaaagtagtattttctgccagttagccttcccaagatatcaaatccaatattggccaaatacatttttgaattcctaaaaagcctaaactgatgtcgtaacacagctgtatattaacataaaaactctgtaccttagtaaattattaatatgagcgattagctcacagagtcaatgtaagaaacttgtttcaactcttcatattctagcaaaaagaacacacacacacacacacacacacacacacacacacacacacaaaacctgatttaagaactaactaggtgattaaagcctacttagtttttaattgaagtgcatattctctaatcccaagaggccaaactaatcacctttccctttttgctgctttttttctctctatttctgtaattattataatctgtctgatactgtgtttagctatatatgggtctatcttctctcattagatcataagctccttaaggaaaaggccatatttccttgggatcccacttaaaaaaaaactggattacaatgttgaaatttttatatatttccatgtcattctccaaacactccccagtttttaccaaccataaagaaaaaatgagaagagtttaaatgataagcaaatacatatgtaagtgttccataaatacactatgtttgaagttatttaaagaacttaatataggataatatttaatagagaaacttagtctagatagagcacataaaaaacattcttggaaatttgtggataaataaaagttccttgcatctgtattttcctttcatcttgaaaacatgccttgacaaaagtaagccagagctggagtacaagattcagacattggtagatcattaattggttaaactggattttatcttatttccccttttatggatccctgtctttgtgtggaattcctgccacttgctggctgttcaaggcttgccaccaggagactttctccatcaagctaggggatatttctccctcactgtcccccaccaaatcaatattcacttgctctctgactactccaggtttctgctgtctgagaatatgaacatggatataccttttaacatgcgtgaatactattcatattttaatctcggccccactgaatgatagcaaacgctgtgaattttatgcctatctcaggctacagctagtgccttatcttgcacacacacaaaaaaaatcttacttttcctacttgcttccttcttaagtgtaaaaagcaaaaagaggaaaggtgccttttgtaaactgctaaagagcagtttacagaagagcagtttactaaactcagacctctcattttccctcacacgacaatctaaaacagaatgttaaagtgaatttatttggttctgtatacctaactattcctgaacatactgagttctcttttaagaaatcatacctgcctgacaggctgctttgcatgaacacagcattccccagccttcaaattgctgtcagagccgttgtgtcattttgacccacaatatggcagtattatccacattctatagatgagttaacaaaagcttccaagtggttaagtgacttgcctgtaaagggttaagtgacccacctctaaggggtagaattggtctggacactctgcccctctatcttcatgcctttgctataatacacagctacgcttgctgaagattaaggaagctgcttttgataaagcgtgattcttgtagatattcatctcaggaaaaaaaaaaagaaaaacgctggtgtcttcatctgtagcatttgattattacattttccttatctgtttcaacttaggatgacttccttgttcgcttaattgactggtaattcctttgtttacttttttccaaatctcaagaagcaagtctagagtattaacaatggttacattagcatttaaaatttttttttgaaatttgagtatttcagaaaggggtaatttaggcaggcatgtatgtagaactttgcattttaattaaaaagactcaaaatgaaatgaacctctgacagtaacagatgactacttctaaaagctgcattactacttgatatatgctcagtattttcttgtgggtaagtcctacgacttgtttcaagaaaagtgacaggactaaaacaattaaaaaagacaaagctgctgttttttaatcatatgttcataaataaaactaggttgtgaattgtttccagagaagcaattgacaaagtatgagtaaatcactctaagaactaaagctgcgttgattttttttaatgttcaaccaaacatctatccttgtccaatgatgaattttctttgacaaataaatatttacaaagtatgaaatatagactctgtgcctttcctaaggccaaagcatactgtttaaactaaaatttaattttttttctcacctcaaatacaccaaaataagaacataactaaaaattaattctctcttgtagtagactgtccattaatcttttgttagataatattagcattgtgagtgtcaggtagaaagaaaaactgtaatttctagattgatcagaaaatgtgagtatttatggatttgaagaaaacaataaagtctgataaaatagaattttctgtaacctcccttatggagtcaagaaggaggaatctttcaacatcctcccattttgcagtgaaaagtcttcatgcagtaaatagtttgcttgggtagatcaaagggttaatttacttctgatttgagaagagacgcagacttccctgatttttttacaaaaatgtgttgtgtgggaggaaggtagaggcctcagaatgaattcactaattggggttttcacctgctgtgagtctaatcgaatacaaagccttatttgtagctgaagaggaagagagattatgcagagtgtaagaatttctgcccagttttgaaattccgcttatttggcacaatcggtggggaaaggcagacaaatagttacaagtttgagctgttaaggtagaccaggaatgctgtagtcagatatacttgaaccacattaaccagtgatccatttttagcaggaggtggtgtgggtcatatacatgggttatcgctatagctggcaggctaataggtactccaaattctttcccatgaagcaaccgtcggcctgtgaggttaatgaagtatggctttattttagtgaagatgctaaaattcacatctttttagatgttcggcttgatataggtggctctgtgaagctttgagaaatcttattaaaagaaaactgtgtgagagtgaagcagagctcgactttatctggaacctgtctggtgaaatctctggtttagatggcagctggctcacagagaactttcctgagtctggcttactctgcctccctaaagagacagggcctggaaaaataggcttttgtgtgggtgtgaagtgctctgtgtctgaacttagaggcctcttcatttgctggttaatgtgacctggctggatattcttacatccagaagatgttggtttcagattgatctagggggattgttatatatatatttcaattagtatgctataatatttgccctaaccagcaatgattcaccatacaccaacccatttgttagatgtctgagtcactgttcatggttagtacttgtactatgcaaagaggaatatggaattcttatgtctttattgtatacccaaatgctgacattttactatagaatatgtattcgagttaattgaagtgatacctatactctaaatgaatttttataaagtgatgcaggttatactaaaacttagggcgcactatagatagagagaagctgaaccctaggagttggtgaagtctctcgggaccatccctccaggcaagtacccagttcaaaccattccttgtctttgtcctttcctatgccactctgcatttttacacagctagcatcaggccaacattgaaaccacatgcaacccagaaaggaaaaagatgtgtttgtggaaggtaggaacagcctagtttcagctgttggcccttcacagcctccactagatgggctcattcgaacccaagacccttccaacagtacactgcaaatccatagctccaattcagacatcttccctctgagctcaagactcagatgtccaactgtctcttggatacctgcacttttacatcaccacctccaattcattatgttcaagactggattcatcatctctttcctaaccctcttctgccccctcctcctgaaattcctagctcggagaatgctactcatccaatctttgttgtcactcaaggacaatggtccttaaccttcactgcatattagaatcacttggagagtcttagaaatcctaatgtccaagaccaattaaattagaatctcagggtggtgagacccaaacatctaaatttattaacaatccctgagtgattccaaagggcggccaagcttgaggactattgctttacttcttccctctcttccattcatacatccagtcagtcaagactcctgtagttggaaccttattgtatcatttctccacctcctctgccactgctgtaattcagatcctcctcatactgcaatctccttgtacctgatgtctgaatttcagactcttgtcttctgatcaagcccccataccattgcctgagtgatttttctaaaagacaaaccggacagagccacactcatgctttaattctttcttccttaaaaagctccctcatacctttcaggatacaagtcaaactccagattgtcacactaagccctttccagtttgcccatttctctaacccttatcttgacattctctccaaaagatcaagcagaccgttgaagctcttgtaaagaacaagctggttgcatcctttttaccctcacatctgctgttgtcaccatcataattgttgatatgcctttaccctcaaaaggccagaagctctttgtgggcctacagaggaggcttctctgaatatttatccaatgactgagtctcatctgctttttagccccagagtggggggatctgactttctcctctatcagtagtccccactcagcatcaagtctattgccccagagggtggctttggctggatgggtctcagtttggtcagggtcctgggagaaacagatggtacattcaaacggaacacttgaagagagtataatgaaaaggctatttacaaggctctaggcaggctaggagaaaaaaaaaaaaacaaggaatggtaaacttttgcccaaagggataaagggaggaatggtttgcgtaactggtggaatgctattgctgtaggaaaggactggccaacaagacttgtggctgcaggtcaaggaactcagcagctgccaggccagagatcagtaggagggaacctgaagaataaatacccaaacatcaccttcctcctgtcctttcctctccttctgtaggcctttcatcactgcctcccaattggctgaaagcaaaaggaagccaaacggcaggaaagcctgattgatgtccccacagaggtccaacctcctgggccacagagcagaatggagaaggacaaagaatagagatggatgggagaatggggaagcatcctgcacagtcccttaggtcagagatgcccttattctctaaagataccctcaaagtttaagtggttcaaagaccagagttttggctacgggaaaatgtactgggtcgccttctttgacctcatcccatttcatttcttctttatctctatttctagcaaatttactcttctctgctctgagccatcagtgagattgtctatgagtatactagaaaaaacacagacctttctcacaggaaaagaagccatgtctcttcatggcagcatagcagaatagctaagcgcatgagtcttcgagctggattccccaattccaatccttgcaccattctagacagtggtactgggaacaagtaggtcatggctgattctgaagtcaaaattttagctgaagtttgttctggtagcagagcttcaggctcttttcatgtccgtggttcatatcaaaacagtaataataataataataatataatcagaaggaggagaagaagaaacatctactataaacaaacaatatattatcatacatggcatcactacataatttacatatgacacgaaggtatatcaattatgttcttttccaaatgctttcctctaataagcaaaattcataatctgactgcaattgaacaacaaaacagtctctgtgatgcccgcgtcatttcttaatactttcagtatttaattataatatgacgtcaagatttgggaacaagtcttcaagtgcctataactccagtctaaaaaagaacttaaagatgtatttttgaggattgccatctgtcaatttttttaaaaagtctgaatagtgatttcttattccattcttttttcttgtcaacagattattcttagtagttttctaattggacactgagaaaagagacttaagcatttatagagaagcgtgtcagaactcctgaattttgagcaggtaatttaaaagtgtaaaacaaacaaacaaaaaacaggaaaggaagagagtgacaaatgtcttactatccaggtgttacaaatccttagtttatcgatttgtaatatttacaaatgtccatgctctgaggcttctgtcttttcgttgaaataaacataaacagtagttaagtgatttgccacactgacacagagattggtgtctctgatttactgcaaagggcactacttcctcattacaggacactaatccctcttccccaaggatcggagcagacctagaatatactattagaccaagggacaacttcagccaaagcaaatcttagtgtgcccccctcagaccgtaatagcagctgcctccacaactcactagcttaaaattgctaaagggcaacactaagtaatctcagtgtatgagccagaatgccagaagaagtgccatatttgcttaaaaatagcaataccgatcatacttacatgcacatatctttagtgataacatttacctttatatttggtttgttaaaggtaataaagaatcctggcattcccttttgcttttgtccagatactttatttttgcctcttttgccatgctatagcattagataaagcaaaacgggtgtgcttccacctaaaacattctagggggaaaaatgttgagcagaaaaggattatttcaaaagaagccggatatggtggcatgcacctgtcatcgcaggcacttggaggctgaagtgggaggattgcttgagcccaggagttgggagaccagcctgggcaacacagtgagacccccatcccttaagaaataaattttaaaaaggggaccacatttaaactgtagaccgaagtggaatgaatcaatcggaaaggagagtggaaagcaaatgtttgaaagaaaataaaaagaaaagcaagccaacaaaataaatggacaaagaagggcagtgaaaatatcactaacagtttatcgtaagatgctctttggatgctaatctaaggtgttatgtgaagtttgcagaaaattcttgtgctaatgaaggctttcttcttcttttgagtatttccaagcttgaaataattgtgtgtagttaacttctatcatcatactgcaaactctaaaattagaattatttgaactgttcaggccctgtaacttttccaataaaatattctattagaaacaagttccttctagatcttcctaaaagaatactaaaggaccaaaccgtgcaacagcactggtggtattgtcttaatttagagagtccataccagtgattctcaaacattagtatgctcagagtttctggttcaataggtctgggccgggcccagggaattttcatttctaagaagttcgcaggtgatactgataactgctgttcccagggtctacattttgagatccgctgctatgtcacaaatccaaatccaaagtctttttaacaatcccttttagcccaggatgagcctaacggcaatttcacgtccttatcgccggccactttaatcttcaactgaggaggaagggagagtgagaattatgtatataatttttttcttttattttttaaaaagaaaactccaagcccacactcttaattatctgggatgaggtcatttgcacctgggtcatttatttagacaacaagtagtcttgctagaggctttaaggaggtgttagcagagcggtgtgtggcttccaggttcctgggtctaccttaaatccccatcctctttctttctttctttctttctttctttctcttttctttttcctttccgttttgaaagccccaactgcccagtctctgggtgtccgggttcccaggtccctaggtgggggcggagcccgacacggccccgccccgtctgcccgcagcgccccctccccggcccgcccgcgccggctcctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaagggtaagtggatcgcggccccggccccgtctgatggccgcaatccgtgcacttgtggcgcgagcagggggcaagctgaggcggtcaaaacttggacaggcgcggcggctggacccggggcgccgggcggctgggcgtctaggaacctctcccgcgggttcccgcggcgcggctgcaggtgcgcccccggggtttctccccaggcgccgggctagtgggggaacctcttccctcggctttgggacgggctcggagagaaaaagctgatttctccccgtccccagaggggataacgcgttcctcacgcggggattggggccgggggagcttttcactcctttccaggctgccagtgtggacgtgagcaaggctggctgttcctaaatcgtcgctcttactcgtagaaggaaggggcgcacgcggcgctaccttccattgcactgcaagtgccaaaaggtcaactttctgcctgatttcttccgaggattccaactgacatttccctcgctgcattttctaccgtgctcattccatgccccaagacctgcagaaatcaggaaagaaagaacaaacaactaaagcccagaagtcaaagatttcagggggtggggatttttgtttgtttgggcttttttttttttttttttttttttgcccttcgggattgggtgtggagtcatttctagggtgttctctcgcatttctccaggtgtctgtgctcatcttcaagcaaagtttgtcactcccaatcccagcacggcaataaaaagggcagaacactttgcttatattagtcaaatttgaagttaagtttgaagctttaaattgaaggggtttagttgctcgagggaggcataatattaattataaactgtttttacatcatgaaaaaaatccatccgatttaagtggtgaacttttaagtggcgtctttaagtgaaatctacatttttccttgggcaataaactcttcttggtcttctgctttatccctgtcatctctccttgtcacccaccccccccccccccacacccccaatcaacctttctttttttgcctagcttttttattgccttttactcaagcccctctttggaggatacatttgctgttggagaagcgagtggagcaaatgaagcaacacggttatatgaaaggtctctgacccttgaacaccgtggaattggtttcagtcatcattgtttgatctccgattggacacgaccctgaaaagaaattgctttgaccaaagttgagggtgggtaggagttaaaccttgaaaagcaaataaaacggaggacaactaacagctggaacagccaccgaggcaatcatctttgccctggctttagccagacagaataaaatggtaaatatcccagggaacaagaaatggggaactagaatggatttctgatgcttatattgatgcccacccctccaaacccctgccccacggtagcagaaactttaaaatatattttaccatccacaccctgccagtattccagcaatgcaagccaagttcaacaattcagcacgcaaatgccaaggttcctctagaaaaagagtctgatcctcagattaaagggaaatcatttgtgtgtgtggatcaatgggctccagattatatatgaaaccaaactctaatcctctgcaaatcgcaagagaacgctccctttttatattgctgcatagcgattagttttctccctgggaagtagtggacagatagttttttaaaaaggcaactgtttggaatattttcagtaccaaataacaatggtggcagaagaaatcttattttaattaggcaactgccattttcccagccacagcagtagatatttgttactttttataagtgtttaatgtttgtttttaagaaactaaaaaagcaattccaataagtctgattattccagcactgacagcaggaacagctctgaggcagttataataaccttgcacactacttgaaactaaagcaggtgagagaaaatttaaattgtatggtaggaaattaggtcagccttgtgctcagtagagtaatgctttaatttcttattattgacaagtaggtgttgctggggtcttttgtcatagtcgatgactttatattttaatttgcatcagggtcctatcaccgcctcaaataaaagggaaaaagattatcatggtttgtagaaagaagaaggagaggggaaatcttcgtataaatactgctcagagaggcatatctgatgccaggctttggaaccagcagggccaaaatcaataacattttttaaagatgtaaagagcgttttaaggattatttatgaagctgatctctgtgttaatgtacgtacagacttgtgatctatgttgaacattgttgttctcagaaaggccaaacaaagatgtacccattaacatgtgaacaggtttcagaatttcccttttggttgttcatggtatatggggagtgtatttccgatgtggagagtgaaatgcagaaaagagacaattaccaaaacagtgccacccacccttccactccctcctccctagcacaccgtgtttttctatatcgtctgcatattccaggtaaatgtgggctcttctcatggagttactgagaattctctactgttttagaaggcaggcacagagtaagaaacgaagctgtaaaatcggtattgatcacagacaaaaatgtggtttgtccttcaaggtacaagatagatatgagttatgcagatttgtgcttacagtttcatccagtccatattcatagttcctatctattttggagggttaaatgtgtcccagtggggctctggattcatcacaggtagaaaataacaagccgtgaagtgaatatttggttcgtcatatagttaccaaagaatctgaaggttttttggctacgttgccaagcatttttagcattaaatgattaaaagactatttttctcgttttaagaattagtcacaccctttattcttttcttctttccacttgtgctcacttcttttgcttagaactgatttgcaattgaagtgaaactaagactgcaaaggtgaaatctaaatctgtttttctagttcttttgcattgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttgaagtccattccagatggtggcttttcaccgtggttccctgtctctgtctgatcaggcttatcagctcagctaaatgtttttctgcagacctatagaagatgctacggtccttacaaatatcctggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaacagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcaggcttgctttaaatttcaccgccagtagggcgcagagccctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaagacagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatattgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagttctgttttctttcccctcataacttgaattattttgaatgggtacagagcatacaaataagggtttgaaaacaccagtctttttacactggacaaatgtccagatgtctggtttgtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaatggttttattaaacatttttctaattataaatgattaaatgtcttctagaaaacctgaaaaatgtaaataaaaaacatgaaaaaggaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaatagtctaggatcttcaaaaatgtctttctatacatatatttttatagaagttgaatcattctgtcttataacttgctttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcacctttcagagttaatatttccaatagttttgtaacaatcaaacattcgttgggcttttatccaagtggtgattcatcagataacatctcccatttattgcgggcctattgtatgttttccacatgggatgtgccagcaaccaacctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccaccttggcctcccaaattgttaggattacaagcgtaagccacagcgcccagcctgcctacatccttgagatcccatataagattaactaccagcactgcctttccccctctccaaaattacagtgtttcagagtcgaaacataagcataaaatactgaaaagaaacttttcattgattttagtttttacttattagtttatatttttcttcttcaagaggtatccctttaggtccaaattgctctttgagctggatgaaatggtcggaagccttcaactacagtcagttggtgaaaggtatcttgaaagcagaaatggtgttgtggtctggcgtgtcaaatgtttaagaccacatctagccccctctcctaatcgaacctgaacctcatgtctctggtgaggtgctgaaaatatcaagatgttgctttttccctctgtacccccactccaggcatactctaccgtggaagctacagtggttcacagtatgcatggtaggttacacattcctagagacgcccacttctaaggagatttccattctctaatttgccaaagttcccaagcagcctgttcaacacatgtttatgttacctgccttgccctcaaaagcattcaggtgttcccctgcacccagggtttgaacacaataggattagaaggtgaaaacattttgttagaactgaaaaagtagcaagtatttactgatgaaaagctataatattgcttgagatattaccattggagctctctaatacattctgggtggttttctttttcattccttttccactgattttctacaatgaatttatattatttacagttagatgtttggtaaaaaagtttcttcgtcgatacccccattccatttcttacttagtgtctctatagctacaattcattaactaatgagaacttatgacagaaaagcagcagtagccacacacacacacacacacacacacacacacgccccacatatatgtagataatttatacttaaggaccctgattctcatggactttgtcaggtaactttaaactcaaagagatcatctcatgtatttttagtctgtatgtccagttgtgaaaaatgcagatgtagacattttagtggtagagaaaatagaacttttttgattaaaaaatagataaaaaacaatataagataattaattttagattatttccaacagatctaaaatggctttgcagaggaggtttccatcaagtgttagaaatattgtgtttccctcatttatcggctgtgtacctacacaaaaaattgagagaaaatattgccagagtcctacacaaacaaagcaagacatagtaaagaaataatttaaaggttcactatgatgactgaacagtcattaggaatttgagtccccagaaaattttttacatcacattaatggtttgacaaaagcattgtcttggattttcacagggaataaatcactaaaagcaactggaaatcagttttctttcagcatttgtctgtgactacccccaatagtcatagaatggtagtagagaatagtagtggagtaagtgggatataagagaccaagtgtctcatgtctattttttgtagaccttggtgctttatctttaaaatgtgaggatattggggctgggcacggtggctcacgcctgtaatcccagcactttgggaggtcgaggtgggcggatcacctgagtcaggagatcaagaccttcctggctaacatggtgaaaccccatctttactaaaaaaacaaaaaattagccaggtgtggtggcacatgcctgtaatcccagctactcaagaggccgaggctgaagaatcacttgaacccaggagtcggaggttgcaatgagctgagatcacgctgtagcactccctcctgggcaacaagagtgaaactccatctcaaaaaaaaaaaaaaaaaaaaaaagtaacgatattggacaagtgtctaagatttttgtttttcttttactttgggctgagggtggggcaggctgtttctaaacttgctgtgatcattatttttcaagaggtacctttcggctaactctgcagacaagtggatttctaaaaatgtaatcattcctatgttttaaaatgtacattctgagaaaacaaacaacaggagaagattatgccacccatccgtgtcttacaggctgagtgaggcaagctgttgtcaaatagagaggctcttgagatatttcccattagactcctctgggtcattcatttgttattgagagggtacattcttcgtcactccctagaagtaataatatgtttgattcatgaggtgagttttagatttctattagcatttttacaaatgtaatggaaagactgttccaataggttagcttggtgatttaaaactctgagctcttcaaggctccagaaagcatttacaacatcagtagatgttagatagtaatatgctctggaatttattttgaaatactaatataatattgatttacatgaagtgcaattatgtggttaaaagcctgtccttttctcacaatttatgtctaggtccctaagttcattactgaaattttaagaaaatattttttaaaaagctcaccctgcccccacacacataatatatgctgcttagagatacttttattggggtttttttttttttttttgacagcatcttgctctgtcacatagactggagtgcagtggcctgatcatggctcactgcagctttgaacacccaggctcaagtgaccctcccacctcagccttccaagtagctgggactatagccgtgtgccaccgtgtctggctaatctttttttaaattttttgtagagatggaggtcttaccatgttgcccagcctggtctcaaactcttgggctcaagcgatcctcccaccttggcctcccacagctctgagatcccaagggtgagccactgcacctggccttcacaatttccaatgtcaaatcttactacaaatttaagtaatcaagagtatttacatatggacagatatactgaccaacagagtagaatttaggctgggcacagtggctcacatttgtaatcctagcacttttggaggccgaggcgagcagctcacttgagctcaggagttcaagaccagcctgggcaacgtggtgaaaccccgtctccccatctctacaaaaaatacaaaaattagccgagcatggtggcatgtgcctgtagtcccagatactcaggaggctgaggtgggagggtcgcttgagcccgggaggacgagactgcagtgagccgaggttacatcactgcactccagcctgggcaacagaacgagaccctgtttaaaaacattatttcttagcctgtcttattgggggggggtctcttaattataaatacaataaaatatgtggttccccaatggttcctttttaaattacaatgtgagtttttttgcatttgtgatactgtcagtatagtacaagaagaccagtttatgaaggagacatgtaggtaaaaataggataatgtgaagagagaatcgctgcacttcagaaagctgattttatttcaagcagtttattaaaatctagatgcaccgtatgttctggtgttacttattccaatttccttttccttcattgaagccctcttaaccacaagtgttttctcaaggggtactggttttccttttcttaagttatagcgttcttcagaaggatctagccctttttaatctgttgcccaatttttggatcctactatccagcatgatgctcacctgaatgatgcgaaagctctcaattttcaaaaatggacttctgagtgtttttggaattcttaggaaaagtggtctttaaaaaccataagatttgaaggcagtctatcagcacgtagcccttagcttcatgtctatggtttgcagagagcttcagaatgttaaaatgagggtttaattttagggtctgctgggcctgaggttaggggtgtgattcttcagcagttctagttaggagaactagttaagtcctagttaagtcaatggggctaaaagctttttaaagatacatcaatatcattataaatcagcaatttgcaagagagttaaaaacactgctatcaaaatccttgtacctctttcctcagcttgcccaagaggaagggatattgtagttatttgttcactctcctcttttgataggctttctacattccattaagtattccctcctgaggatgctcttgggttagaaactgcaggattctgaatgactatgaattccttccttttgcattaggagcttgtcctaatgcttttctcagcatattttgtgaactaaactgttctccactaagctactcaatatttagctttccttggctcttgcttctagttccttaatatattgctcagtgttaaaacctctgccttttgactttttactgccataacgctttgaactggaaaggatagctagattcagatgccagctttggtgtgacctcgggcaagtcccttgctttctattggtcttcattttcttatatgtcatgttggccagtgatctttcatcattaaatgactggttttgttttaacccctggctagagtaaagcttggttgtatgaatgttgtcagccctaaacccccagttcctctttgtcaccaccaacctaaaggatatgaataataggataatcatatttattaatttaattttttttttttgagacggagtctcactctgtcgccaggctggagtgcagttgcacgatctcatctcactgcaacctccaccgcccgcgttcaagcgattctcctgcctcagcagcctcccgccaccatgctcagctaatttttgtatttttagtagagacggggtttcaccatgttggccaggatggtctcgatctcttgacctcatgatccacccgcctcggcctcccagagtgctgagattacaggcgtgagccaccgctcctagcctataatcatatttgtaataattgtactttatttgtgtagcactttacaatggcgaagagttttcagaaataaccatatttaatcctcacacagctatagagtaggtggcatatgacctggattttctatcaatttcagtttcagattttttgtcctgtcatccctttgagtgtccttccagtttttgatttgggaaataatgctaccataccggtggatggggcaacttttcccttctttccatttggacttgagcagactgagactcaagacttgatttgatttatactcactatggtagaagataaggaaccaagtccagaacacacattttacaaactccgagttctctgttctcaaaggaacatccattactcttagcatgatttataaaactgctttatcggcataattaaactggaatccatatgacattctttattccctagctgacaaaattagcacaggagatttactcaaatttgttattaaggctgttataaatgttcttcctttactattcagcttataaaagaaaaaagaaaaataatctgctcttttaactttgattaggatccattgactttccccatttgtaaaatagaaatgtaacttccaaatcaaaatttatggcattttaatggactgttctaaatattataatattttttcttgttcaaataacttgatttaaagcttctaattgaagaacataatagatatttctgaattgcatctctccaagcttatttcagaaggaaactcaaaaagaattgttccttagactttgactggtttacagttttaaaagagctgccaaattgtagtttactgatctaaataagaggaacattaaggttacacctgcagctagaagaaaagtgctggatatgtacaattttatgtagctggatctgcagaagatgatttttgcacacagagtaaaggcatctaaaaacgtgtctgctcttattcagacatttccaatatttcttttttaagcccacaagtctgattacctctgtatgtctcttgggagctgcaattttgctggaaagagattcagaacagtcagagcactcacataaaatagatagtttttaaagtctgtaccctctacggtagtaataaaatgacctaaaaatattctgaaagtctctcttatgacatagtggatgaatcattagcttatttatgaattggtgatattctgtgggaatgtttcaaaatttgctattccacaaagcgttcatcgcttgcataactccaggaaagtcattacaccccctcataaatagaagcttatataacggagacaaatgttgcttatattgatatatttacatacagatttctttaccaagcattaattttggtaagaaagtgattgtttttatattttactttcttggtctgtaaagaggctatcactttaaggccaggcatggtggcacgcacctgtagtcccagcgcttccagaggctgaggcagaaggatcccttgagcccaggaatttgagtccagcctgggcaatatagcaagacgttgtcttagaaaaaaaaaaaaagaagctatcactgaagagcagtgcttctcaaactggtgaagggccaggtttttgttggtggtgggtttttttttttgtttttttgagacagagtcttgctctgttgccaggctggagtgcagtggtgcgattttagctcactgcaaactctgcctcccgggttcaagcgattttcctgcctcagcctcccgagtagctgggattacaggtgtgcaccaccacacccagctaatttttgcatttttagtagagacggggtttcaccatgttggctaggatggtctcgatctcttgacctcatgatctgccagcctccgcctcccaaactgctgggattacaggcgtgaaccactgcacccagccgcggtggtggtttttaacatactacacatcacagatttttaggtggtgctaatgaaactgacaagtatgcattcacaccacatgtaactcaacagtcaagttcaacaacacttgacctcgtctgtaccctgctccatgagatgaattcattgatcatgaatttggatgtcatggcaatgtcaaattgctatagaagttacttaacacactgtccatatctatgcttgtgaaagaccatattttgagtagcactgttctagagcacttaatttttgaaagtataaatgtaaactcaaatcaagtgactcaggtcgggggaggataattaaccaaacaggaacacctgaaaatgttatttatgcggtttaatgttttgccagttgagtcaagttcaggcagaggagggatctattttctttcccacttggtagctctccttagcaattgttttagaagacaaagcatagaaatcattgtgttacaggaaggaaccagagattaagcggcagagccactgctgcctagtttaatgtctctcgcaccccctataattaaatataatgtatataatgtgataagtttaaaatacaggtttgcttttatctagaatataaactgtgatatatgcactctttatggggtgcattcagtgggggaactaattgattatactgtgactttcctattgtcactttatgagtttaggtttggaggcaatgttttgcagcaacaaaattgttcattgactttgaggctggatttaaattctgattctgtcaccagttctctgtggtcaaaaaggaagccactaataattttaaacctcagttatgtgatgtattaaatagttatgatgagacttatcttgtgttgtgaggattagaatgacatatgtaaggtaacagaatgtctgatgtagtaactgctcaaggaattataattgctattagtgatatgcattattattattagttattattatcatataccagtgtctctccttatttaataatctattgggttcctgaattgagataccaagaattcagatagtgagagacacctaggtttaggtcttcacatttgacactcaaggagccactaaatttttctgaagtattttacttcttaaccaaggtgataaagatcacctgatcacaatttatcctaacttttggaaagcatacacgtactttaatttgacatgcaaattaaaataatacattttgtactgtgttgtttgccctcccccaattctaaaataatatatcattcaggataaaaaagactacactttgggaggccgaggcaggtggatcacctgaggtcaggagttcgagaccagcctgggcaacacggtgaaaccccatctctactaaaataaaaatttaaaaaagccagaagtggtggcgtctgcctgtagtaccagatactcgggaagctgaggcaggagaattgcttgaacctgggaggcacgggttgcagtgagccaagatcgcaccactgcacttcagcctgggcaacagagtgagactctgtctcaaaaaagagcataaatatctaataaatgatggtggtactagtctgtggtagtggaggtatcacagaatggctgtagagatgaggagggctaaaactgtgaaaagccttatatggtatgttgaaggttttttatactaaggtttttgatttggaagatgtatcaatcagggtctgcctggtcagaaaacataaaccctctagttatttcaaacaaagggaatttaatgcgggaaattggttactcaagaatggaagtgctgagaagccacacacacagcatgaagtttctgttatacctagggctggagggacaatgacaagaggtggtatcaccagagccccagatgtcatgggcatcaaggcggagttggaacctttggccagctgggaccaatgagggaggggctccgagggagctggagccaggaaggagacacagttagccagacctattgccggaggtagaatgaaaaaggaagtacgcccggcttctcctttccgcctgccctctaggcttctgccagtgactcctattggccaaacttacttggaagccaattggtaagggagcaggaaaatgtactgtaataaacagcagagcagagaaaaggcagagaaagtatcaaaaaccaacaagcaaatgattgaagtacaggagatcccatggacagtaaggcaaccaaccctctatgcagatatttcgggaacaagaaacataaaaaaactaaaaagctttcataggagtttgaggtgacatagataagataccagaaggacatcctgggttcaaaggaaactgatcttaaaggagaggaggtagcaattaaaacaaattatctgcagagaagtccaaacactaaggataagcttccatgcatttgatgaaagtacttgcgacgtttacaggtgtttatgctcatgactctcaagactaaatacagacataccttggagattttgcaggttcagttccagaacacttcagtaaagcaaatatcacaataaagtaagtcacacaagtgttttggttttctagtacatataagttatgtttactctataatgtagtctagtaagtgtgcaacagcattatgtcttaaaaaacaatgtacataccttaatttaaaatactttattgttaaaaaagctaacgatcacctgagccttcagccagtaatgatccttttgctggtggagggtcttgcctcgatgttgatggctgcacagcatggtggttgctgaaggttggggtggctgtggcaatttcttaaaataagacaacaatgaagactgccactcagttgactcttccttttgtgaaagatttctctgtagaatgtgatactatctcatgaaaccacttactttgctcatccataagtagcaactccctatccattaaagtttgatcatgaaattgcagcaattcagccatatcttcacgccccacttgtgatttcaattttcttcctgtttccactacatctgcagttacatcctccactgaagtcttgaacccctgacagtcatccatgagggttggaatcaacgtcttccaaactcctggtaatgttgatattttgacgacctcctatcaatcacaaatgttcttaatggcatcaagaatcacttccagagattttttttttttttttttttgagacacagtcttgctatgttgtccaggctggagtgcagtggcgtgatctaggctcactgcaacctctgccttcctgggttcaagtgattcttctgcctcagcttcccgagtagctgggactacaggcgtgtgccactacgcccggctaatttttgtatttttagtagagacggggtttcaccattttggccaggctggtctcaaactcctgacctcatgatccacctgcctcggcctcccaaagtgctgggattacagccgtgagccaccacacctgacttccagagattttccatttactttgcccagatccatcagaggaatcactgtctatgtcaagctatagccttacaaaatatttctcaactaataagagttgaaagtcacaattttttcttaatccttgggctacagaatggatgttgtgtaagcgggcatgaaaacgtgaatctctttgtacatctccatccaagcttttgggtgacaaggtgcattgtcagtgagcagttatattttgaaaggaaacctattttgaacactaggtcttacagtgagcttgaaatattcagtaaaccatgccgtaaacagatacgctgtcatccaagctttgtttttccatttatacagcacaggcaaagtagatttcacataattccttttttttttttccttccaagacggagtcttgctctgtcacccaggctggagtgcagtggtacgatcttggctcactgcaacctccacctcccgggttcaagcaattctcctgcctcagcctcctgagtagctgggattacaggcgtctgccaccacacctggttaatttttgtatttttagtggagacggggtttcaccatgttggccaggctggtctccaactcctgacctcgtgatctgcccgcctcagcctcccaaagtgctgggattacaggcatgagccactgtgcccggcctgatttcacataattcttaagggccctgtgatttcagaatggtagatgagcattggcttcaacttagtcaccagctgcattaggccctactaagagatacagcctgtccattgaagctttgaaggcagtcattgatttctcctctagagctatgaaagtcctagatagtatcacctttaaatagaaggctgtttcatctatgttgaaaatctgttgttcgttgtagccaccttcatccatgaccttagcttcatctggaaaacttggctgcagcttctgcatcaatgcttgctgcttcatcttgcaccttaatgttatggatatggcttgtttccttaagcttcttgaagcaacctctactagcttccaacttttcttctgcagcttcctcatctcttttagccttcatagaattgaagggagttaaggttttgctctggattaggctttggcttaaagaaatgttgtggctagtttgatcttctattcagagcactcaaactttctccatatcaggaataaggctgttttactttcttatcatttgtgtgctcgcagggtagtacttttaatttccttcattaacttttcctttgcattcacaacttgactgtttggcatgagaggcctagctttcagtctgtctcatctttcaacatgctttcctcactaagctcaatcattaatagcttctgatgtaaagtgacagaggtatggctctttcttcccttgaacacttagaggccattgtagggttattaattaccctgattttaatattgttgtgtctcagaacaggaaggccagaggagagggaaagagatgggggaacagctggtcggtggagcagtcagaacacgtatgacgttgatcaattaagtttgccatcttatgtgggtgtggttagttgcaccccaaaacaatttcagtagtaacatcaacgattactgatcacgattcaccataatagatataaaaataatgacaaatttgaaatattgagggaattttcaaaacgagacacagacccaaagtgagcacatgctgctggaaaaatgtccatagacatgctcaacacaggattgccacaaaccttcagtttgtaaacaatgcaattttcacaaagtgcaatacagcaaagtgcaatttaatgagatgagcctgtaatgagcctctttaaagcaggaactgtcttcctcatctttgtcaccagtgcctggtgcatggtagcctctgaaaaaataattgttcattgaatgaagcacagtagagcaagggagagtgattttgctcgggaggaaaacaaataccactcaagaagatggaaagatacagatgagggttttctaaggcggattattaaactggcaagatggaactctggagagatggagttctttccagaaagtagaagataaagcctcaaagtaattaaaatagggaatatcagttaagttgtagattttattggcaatttgttatcttagcaaaaccaagtgaactgctattctggaattaattttgccctaaaaggaataattaattgataaggagaaataagacccgtaaaaagtgtcactatggattcagaatttatatgacaaagaaaggaaacactgaacacaatttgatgtgctgatggcctcgttcgttcattggtttcctgcttcagtaaacatttaagagcgtgccatgtattttcaaactttagggcaacaggctaaaaatatcaaggagaaaaacgtttactgagggtatagaagtttttatgatcttacttttattgaacattaaaacatggatgttcattctagaaattttagaaggtgaagtgcaaaaacaaaatgaaaatcacctcacatctcagtacccagaaatagccactatttacattttaaaagattgcttccggtcttctttcctatgcatttttatatagttgtttgagataatagaatgtttaaagtgttgtatcctactgtaatcataagtcttctcttattcttagttcctcagagatgttatttttcgctagttgcagtttattggggtaccacttttgtaaaaaaatatttcccaatttttgaaaattgtgacaaagaaaagtcaaattcgtgttgaatttatggaaggaaatctttaagaatctggaggcttattactaacaagcttctgagaagaaagccaagtaaagtgttataataccttctgtccaacaagctacttatgtataagtgatgttacagaataaagtcagtgtggtcaaaaacagacagtcagttatcagaaagttgataagtaacatttatcctatgaaaaatatagctatgaatttaaatcaatagttttctaccacaaatatcttaatggataaaattttctttaccaaatatgtatggtgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcagttattaacagaaaaggaagattgcttcctgcctcttgggtgaggaagactcatgtataccatagatatggtcagtttacatttacagttttctgtgaggcattgatttttttcccccataaatatggagtacttagaatgttcaaaacctttctctgggtaatagaatgcacaaaagtataaggcatgatccctgttcattgcccaagctggcgtgactctggtcatgcagcggacttcatgatgtgatagaattccttgcctatgagagtgaaggagatggtaccaggtctacttgtggccggtggtggaacacttacattattctaagtcctttctgtctgtagaacccaaatgacaaccatattattttatcttctcttattgctagtggtatcgtttattaatgccaacgtatacccattttgcttttcaaggttactttagatgtcttaggttggaatgactgaaggcttatacattcaaatttatatatgacacacacacacacacacacacacacacacacacatatcttattgttgcctgctatctttctacctgttgtataagaaatcctttgaaaaaagcctatgtcagcttcacaaaagatgttactgtgttttgggggaaataaaattgggaagtaataaaacagttaataaatgttacaagaccgtgtacaccaacttaaataagattaaggtcaaacgtatggtaccttatataggtaggaagagcagtattaattagaataattagggagagttgtttggagagtggaaaaaaacattgttctaggaagaaattttgtaatactcaggtaaagtaaaatgtagggccaagatattccagatagtgtagcagcataaacaaaggtatgaaagactggcttgtttgcgagtcagtgaagacattgttctctgagaatctactccagatttttttttttttttttttttttttttttgctttttgagacagggtctcactttgtcgcccaggctggggtgcagtggtgcgaacatggctcactggtgccacaacctcctgggctcaagtgattctcctgcctcagccccccaggcagctgggactacaggcacacaccgccatacctggctaatttttgtatttttggtagagacagggttttgccatgttatccaggctgttctcaactcttgagctcaagccatctgcccatctcggcttcctaaagtgctgggattacaagaatgagccaccgcgcctggccactccagatttttaaaagggaaatctgattcagtgcccctggggtgaactaagtgccttaaattatagagtgagaaatttacattgcatttgattggcaatgggaaaaacattgttaaatcttcagaaaagagaaataatgaagtccgtcttctgtgttttggaataggaatttggtgggtgagtttaaggacagttagagaggggagagattatttcgttttgttttgaggtaattgacatgatgagggtcttaggatagcaatgggggaaggaaaagggaacgtgactccagaggtttttcttaacaaggtagaattgccagaaggtaatcacagattggacaggttttaaagaaaaagggagttatatgtcttcaaaatttgaaggcgtggtgacacagagaatggtgataccattgaggaaaagaggaaattgcaaactgagcggagcaacagggaatagatatgaatttgattgaattacatacttatgggtttatttacaatttctcttcttagaaaaatttatttttggtggctcatataaatgtatgtgctgccataccataagcatatatttctcattaatcctttcaaaaaccctgtaaaagatatttgtatctccattgtgcagatgaggctcagagaaaataggtaattttctcacattgcaaagcagggatttacgtgtacttttaactcctaaaccagcgatttagcccctcagctatactttcttcctgagaggggacagtggcattttgaagaggaaatactctaaagccatttgaaaaggggaaccgaagaaagagtttggtccacagcatgataaaaatattacttgcacttttattatactttataacaagaagtacaggggcagagaaaggttcctaacttttactgagcaagtatatatccaagatacatctcctctttggagcttttgagatacactatctctcttagttttgcaacagccctaggaataggtactattactgttccctttaaaaatgaacaaaaaaaaaatgaagcttaggaaagttaaggttactagaccaagcttattgggagaccatagtgatgaagaggaagggctttagggtcaaatggatttgaattttacttcttaggcctttggtttccttatttataaaatgggattgaaataatgatatcacagttgaaggtaattatatgagaatttatgttatttattgcaaacatagggtaagcacctaataaatgataacctgagaatttatgttatttattgcaaacatagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttcgaattgggagcaattgggagcccttaagctgaatgagtagacttgaagtcccacttagaatgagcctttatatttttgttctgtggcttgctcagggaagggatacacacttggggagaaaaagacttggattctagttgatgtttttctcctagctgactagggaattcagaacaagttactaagagctttctagtccttagttctctcatttggaaaatgaaaattttaaattagagattctatttctaaggcaccatgtatttcattttcttaataaaaagtatatatattcccctaaagaatactcataagaaaaaggtagagttaaaatttcccaaattatttaattcctggttgcccagtaaccattaaatttctcagcagtcaggcaagaaccacattcccaccttgagacaagatttaggcctttccaaacttaccctcgggctctgttccaagtttatttgtaagtcagttgcatacaatttggaatgaaatgtgttataaatggtggttaggtccctaagtcacagaatcttagttaaccctcagagtgcctgatatactgcaccatgtaaatagaaagcagctgtatgtttctatgggagcaaaaaacttttgtaggaaaaatggtagaaactcgtactgcaggtgttgattattcagcaaacttctctagataaggaggactgggaacttcatcattattggtctagttacattcctggtcactccctcatcccattgactggtcagtttccctccctgtggtccttgtgcaagggtttctgcctcaccccataccctctgctccttgcccggtatcatggttcttctgagggtactactgcccattcacccttgtgctaattaggattacactgggtaaggaaagacatttgttctgtagcggagaagcggggaaggccatcagaggctttgagtgtcagaaagatttggtcttgaatgcaggctctgggatgcaaccgtagggaagttaccaaacatttgtgagcctcattttatctttaacaaagctgataatacagaactcagggccttgtaaggactcgatggtatcaggtacacacgacatttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttggattgaatcttcaaattggtaaagctttatatcaagcaactcccaaatgcagcatagttttgaggtgataaagaagagtcttttcaaggctgggcacaatagttcacgcctgtaatctcagcactttgggaggccaaggcaggcagatcacttgaggtcgggagttcgagaccagcctggccagcatggtgaaacctcatctctactaaaaatatgaaaattagctgggcgtggtggtgggcacctgtaataccagctacttgggaggctgaggcacaagcatcacttgaacccaggaggcagaggttgcagtgagccgagatcatgccactgcattccagcctgggcgagagaatgagactccgtctaaaaaaaataaaaataaaataaaaagagtattttcccggagtaccggtaatattggttccagattcaaatgtattgtccagatacacagagggtaaacaggaacgcttcaggcatcctttattaaaagcacctcagtctatgtcagagggccaggcagtccattatctaatgaaaatctcctaccattgatttattttatcataactgcagctgctaagtaattttgtttaaggaatgatttacatattagtgtcttcagcaggatctcatcattagcatctagtctccagaaaagttaacacataacagtgaaaagaaaacattctctatcacatgcttctgcatgcatgggcaatttgagtcataccacctgttcccctcttctgttatgctagagtatacaaaaagcagagatacgcatagtttactatgatcctagatgcttaaatatcttgaattgtgttctatcttggactcattattcatgcataaagactcaacagattctcttcttgcacctctcaaacagcaacatcaacaaaacccaaacaatgtatctttcctaatgaggtgaaagcatgcataccagcctaagacagaaatgttgcaaaaatgttttttgcaagaaggtcagtttgcttttcccatggtaactaaggttaatttctactgtggttcattttggcatccattttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactgtcaaaacatatgattagttgaagttaccaaaactatttttttaaataacatttatcttaagagctataaataaagaggaaattttgcactagagatgaagttatgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctcacgtcatttctccaccgcaaggaggattgcgggggtggacgatgctccctatttagtcttctgcattttgttgcttacagttcaattaacatgtcagttagagatgacttttggttgcagttaataaaatatctgaccaattgtatcttaaacacagaggagttgatattttttgtagaacaagaagtctggaggcaggtagttgagagctatggaagagttccgtgatgtcatcagagacctgggccatggtttattctgctgtaccatttttaacgagtgactttggtcctgatggttccaagacgactgctgcttctcaggcaggaagaaagagaaaggacgttcagcctcagagtctctttgtctttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccaccttcctcttatgtatctgatcaggttcctcatcctccaccatcccccatgtgacgtctgatcaccctggcctgtgtcttcagcaaggttcctgttaagttttttttagctagaatcccccttacccccatgctttctcttagtagttttccatccaccaaaccccaccctgctccttggctatcaattcccacttgtccatgctgtattcagagttgagcccagttctatactgaggtctctttcccactattgcaatattcctgaataaaatctgtttttaccactttaccgtccatctctggtttttctttgacactcacataaccagagttttgtatgtgtgtgttgcttgacacatcacaaatacctgggatacgtgtactgattttttacagggtgaataatctttttgttttccccaatatcttagaaacctgaatctttaacccctgggcttagtacacagttaggcatataataggtgcttaagtaagcgtcaactgatgattttaaatgcagaagtaattgtcacttaatgaaatatagtcaggagactcatggattttggcctgtcttcctacctgttcttgtactgcaacagtaagtgtattaaggcaatatttttggcagcacaatcatttagtttgaatgcattagtaaaaggtggagtccaaagaattaatcgctggaaagttttgggaaaacccagtaacaactgtttccatagagtaatttgagtgacagccaggtaatagctacttattggagggactccacagtcagagccttgacagggacctgaaaaagagtgtaactgaagggtaaatgtaaaagcttttgggagaacaagggagtggtcaggctgaggcaaagatctgaaaagaaatgcctcctggggccaagctggtaatttgaatgactgaaggtgactgggtgggaactggggcaacctgaaaagcttctgttagggtaacagagcctccgttgcagctgactgttctatgagaatgtgagtctctattgtcaggtcttcaggttcttccagagaagcaagacaacgggaaatcaccagatttttaactaatggcgtatcattcaacaatttcaaaaaccattatgtgagcccaaactgaccaacgaatcaaacacacacacacacaaaaaaagagtctgcagactaaattcaaccagttggtgacctctggtctgtggttaccagagaagtaattgaaatggagttttgggagaaagatcatatgttgaaatcttgggagataagggcagagaaataagtaagccgagacggcggtaaggccaaggtagaaaaggtagcctttaggaaaattaagttaagactttttaaaacaggaaggggcaaaagatgaggttaaagcagatgaggaaatttactgttatttattttcatcattaaaatacgctttccacaaatttttcaactgtaagagagagtgataaattcaaaataggtaatgtcaaccatattatgaagagtatgtttttgcaatccaaaaaagctaaggcacaacattaaaaaaaaaaatctgtgaatttggctttgcaaaggtataagaattaagtcacatctgatcatttttagagtcttaccttttataacaaagaggaaaatttaattaaactggctctgccctggcgaatctgggatgtgtgttcacttatgaagagagactgttaagattcgttaattaatgaggttgagaatagagttgaaggagattggggtaaatttataagtttgtgtcattctgagagttctgtaagtagctgagttacccatgttgtgactgagaaaaacaggagagagcagtgactgaaggttctgagccaaaggaggagaatagtattgtttattccagcagccagagtggcctgtgtgactgtaagtcgcctgtcaagagggagactgcaaggaaagtgcattgatttgatttggagtagttgtaactgcagcatgaagaatatgatatatagggatgataattgaggaacaatttaatggctgcataccttgctgaagttgaagttccttctggagataaaggtggcaaaaaagaaagtgcttaggtagaagagctttttaaaatgagttaacagaaaacagcagactaaatatggaattgaggagtaggaaatgaaggaaatgaatttgaagatttactttctttcaggatgcagagctggtatgtaatccctctgtttccagtgccttctcccacttccaaatttcactgctcctcatgcgccctggtgtgtggtgcagcttcgagattaagcctccagccttctgtcaggatgaagcagcaggtggctgagatgctaggctccaagtgggggaggtgtttagggctctaaagactttcaaccagtccttgtattttcagccacatttcagtcttcagaggaacctggagcctttcatttctgagacttcttggctacataaactggcatgcgtcttgttagttcctcccactccctgccccaatctccttgtctccccaacatcattaattgagcttgggatttctctggtctcctaagttggttaccagcaggtcattttctaagccaccaaaatactggagctctgatctgttctcatctcctctcctgttttgttaattttcttttgggtaaatgccattttttattcctcttctatcaacctggtagagtttcagggataaagagagacaaatgagtctgctccatctgctgtgtttaactagaagtcccaacacccaaaatccttcacacgatgtgcagggctctgcagtgggcctccccctgcctacctgtcaggccttatctgtgcccactcttcctccttcctctctgagatttcagcaatattggccttctaaggattcttaaagccccaccttcttctctgcttcagagcttttttttttttttttttttttttttaacatgtgctgacctattacgctgctgtgttcttacctggcacgctcccatcatccttcaagtctttgcttcaatgtcaccttctccaagaagcctctcggacctatgtttccctatgtatacagtctcatcacttcctgtgtgtttccttcaccattttaccacagtacatatgaatatttgtttgttagtttgtttgagacggagttttgctcttgttgcccaggctggagtgcaacggcacaatctcggctcactgcagcctccacctcccaggttcaagcgattctcctgcctcagcctcccaggtagtagctgggattacaggtgcctgccgccgcatccagctaattttttgtatttttagtagagacggggtttcgccatgttggcccaggtggtctcgaacttctgacctcaggtgatctgcctgccttggcctcccaaaggctgggattacaggcgcgagccaccgcacctggcctacatatgaatatttgattattatccatctccttcgctacactgcaaagtcaataaaggcagagatttattttggttaccagtgtattccatgtacttggcatggttcttggcttatagtacatgcacaataaatattgaaaggatagatgaaaggattatggatagatgaatgtcttttaagcagttataaaacagttctgcctaaagagtcttttttaatcagtagtattacttcaaatacatatttaaatacacatatgttataaatatataaaatatgtatttaaatatgtcatttgtactattttaaatgtatttaaaataatatatgttatatattaaaataatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctccacctcctgggttcaagcaattatcctgcttcagcctcctgagtagctaggattacaggtgtgcaccaccatgcctggctaatttttttgtgtttttaatagagacggggtttcaccatgttggccaggctgctctcgaactcctgacctcgtgatccgcccgcctcgacctccataagtgctgggattacaggtgtgagccaccacacctggccctctccttcatttcttagaagagttttacaaagtcattggtgataaataagtaataccatttcacatctggaaacataacttgatagtaattataaattcacagactgtactttctgtacttatctaagtatgaatgcataattcctgtttatctgtgtgtaggtttatttttcccccatttaagtaaagctctatgttgatgatgaggtttttacgagttgagattttaagaggcctcaaatatatctaaaaaattatagaccaagtatgatgtgttagtgttcctcttctctcagctaattctttaaagatatgttccagaattcctggtctgttcttgaagatctcccaataattctagacttctgaagcctggatattttggcttaatttgctttcaagacagactggatttaaattactcaatttgtctgaagtctcattaagatccaaggttcttgtctgttctagtgagtttgagctggcaagaataatacttgtcatctgaaaagtccattagaatcctttggaggagtgagactggaaaattggagacatattattatattttaaaatatgccacctttctataataggagtatgtggggagactgccttgttttggcttcttgggaaaatttggaaaattagtaaaataggcaggcagtagtagttcaatgcgtattgtatgccaaacactgaatttagaacaatactcccccaaaagcatatgtgctctaaattttatttttcacttaccacctgggagatttggattaaatttcttctgggaaatagagttggtatgaagaaacaaagaccactataccaatttatctgttggaataatcatttagccgtacagctctttccactcataaagttaatgaggtcattattgttctttctagctaatagataggcatattgaaaccttaggcctttccaaaaagtctccataagccattggaaagatagactaaaacactccttgttttaaattctagacctcagttcagtcagagatagtaggatttttgcagtattattaaaaagacagaaaccagctataaaattgaaatgaagggacttaatgttttttttctgtaatatctttggaatgcttccatggctttaaaatgctgaggtgtttctcactatttttcaaaagcatgtaacatgtagatatgtgacgcaaacttgaccagttgttcctcttttctggtgaattttgacacctgctactattacacagagtaaaagtgaaagtcataaaacagaaatacttaccaaagtcaagaaaaatgcatagactaaacaaaggggcaagagaagcctattacttgtttcatgtttcaaaataaaagatgaatggcctatcacttcagtagttggaaattcaacttgagaaggtaggtggtttgatgtttgcccttgttccttacgtttctagatttctctatttataggctagaaccagccctggataaaataatacaagttatgaagagaaatgtgcagttcagcatttttacccttctgaagtgcgctttctcccagctgccatggaaacatggcgtaactggtttcttggatagtctcactcctcttgagttccggctgtgagagctagtgagctcattacaacttggatcagagtcctggaaagtcagctcccagggaaagtggaggacagtctctcatggggcacgggaatggggggctttagctttattaaactgcatacatactttcactacacagtcatcccaagctttagcccaggacagtgtcacattgttcacagctgtattgcatcttgaggtttctgtgtgcatcctacacactttcctaaggcagagacttatctcttccagctgtaagccggagggagtggtgctgcagactcctagcaacacatgcggactcaaacaacacaggcagttaactctcttgagtagtagacttgtagggcaccagaactccgttgcagttcactgacagttaccagatatacatttgtatggcttccgtagcattgtgatggaagctaaacgtttgccctgctactttcttttttttttttttttatttttttattttttttttattatactttaagttttagggtacatgtgcacattgtgcaggttagttacatatgtatacatgtgccatgctggtgcgctgcacccactaactcgtcatctagcattaggtatatcacccagtgctatcccccccactccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccacaatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcattgccaagtcagtcctaagccaaaagaacaaagctggaggcattccctgctactttcttctggtatgcctgaatcactgtttgagaatggattggactttggtgcgtggaaaactggtagcagaaggcttattcactgcagtgggttgggggtaggctgaaaagatgtcagggaggattaactagaggcagaatgtgtcatagttagaagtatttagaagggaagaaagtttgaactctgatactgttccacactaatattcatgccctgaaagaatcagatcattcttgcctctcccacttggatctctagctactggaatttgccaattcttgatatgaacgctaagatttggatggagcttgtgacctcatttagaccatttgttctaaatgctgaatagaaccaggaaaataggaaaagagggtagaattggggtcataagagaggaatcgtcgttctttgaaagaagaaagatgataggaaactaggcacatgagttacgaggcagtggagaaggaggattagaaagggaaaaaaagaagagaaactttatgccaatatcttctacaagatgtttggctggcacaaaactaacactcaatacttttgcataagtaaaggaatgagagaaaatttgggattggatgcttatcccctggaaactgctacaggctggtgttaatgggaaagggatctgtatttgaccaaaagtgcatttccacgtctctacatttctttttataaagagtcaaagggactcaatgatgagtgtgtgtgtaagggaactccacactagcaagtacaggaaaaatttgatggtactggtgaaggatgttgcaccaatctggaggggaggacaggaattggtttctcatggattgatgccgcaagacaattcataccatgagttggctgagaccacttaaaaaagtaagcagtgatgactgggcaaaagagacaaaggaagaaccacatcttttaggggagagagagagaaggacaattaaagggactcaactagatcaagttctgctcactaaaggacagcgtccaggcaaatgttaattatcttcaagaagcaatctgtatatatagcatttcaagatactccgagatgcttttaatttattgaatactttttattggtatttatcataaacaagagactcacaaatatatcccagaggggaggttttggtgtagttgactatagtagttattaaataatctattaataaaagcccacaaaatggaagatagaaagatagaaaaacaaaagacaacacaggatggtgttggtatacagaatttatacttgaagtttaacaacacggaacaagaaactttattaaaatattcatttaaagaacttccatatgaatcaccagaggctcttagtaaaatattgattcggattcacagatctgggtggggcctgagattctgcatttctcataagctccaagcagatactgatgctattcttcctcaaatcacactttgactaacaaggactcacacaggttctctgtaattggtgttggtagtcattcatggttagatgtagttgaggactgccctcttaactacctctcggctgccaggttataaagaaagcaagtctcagtacaagttctgtcacttaggagcatttattagccaatgggtacaaaacaatcttacagcctgtgccagagacacagtgaagtcacagttctgtcttttggggtgcttggtgtgagaggctcacagtctacacaggccacagtcctctattagagtggttctcaaagtgtggtccctggaccagcagcatcagcatcacctggaaacttgctagaaattcagattcccaggcccttcccatacctactgaattagaaaatctggaggtggggcctaggaaatctgcatctttaaactatccactccaggtgattctgatgtttgctcaagtctgaaaaccattgttctagcagcaggattccctcaaccatctaactgaattctggcaactaagaatccggtgaaccacagctggacattttggaattcagcctagggcaccatttctaaagatggagaacctactggattcttcttaaactcaatttaaaggcagggagtgtttctaaatgtttttcaacaatcttcatattttgcaaaccactaatatcactacacaggcccgtctaactattaattaggaaaattaatgaaacccctggtgtaataagagctaaatataactgaatcacttacagtggccgcctgtggcatgaggctttttgattaattgctagccaaccacccttggagttcactcctgattaagacaactgaccacctctacagtgtagcttaagctaacacacacatacatcagagtgtactgttcatgtgagggtttttaaagactcttaaaatttaccttatcagggcataatttaaacactataacatgtttccattttaagtgttcaggttagattttggcaaatgtatacactcgtgtaaccaccatgccaatcaagatataacatttcgatcacctagaaaacacccttgtgttcctttgaggtcagttacctactcccaccacaccccaggctaccatctggcatagtagctaagttttgcctgttctagaagttgatataagtgaaatcaaacagtatgtactgttttgtgcctggcttcttttacccagcttagtgtttttcagatcagttcacattgttgcattatcagtagttagttcctttttattgcactttgcacagtagtatcccactgaatgactttaccacaacttgtttatccattaccttactggttggtttccggtttttgactattatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgttttctttcccctagttgaaattcaggcttttatgtttggtctctgcgatggccataaagctgaaaatgttgacccaagtgacttggatatggattgaattattgccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctaggtggcgtgagtcagggcttgatagaccggtgactgcagaaaccacagtaacatatattgttgttattctgtgctgaacattagaatgattgtaccttagaatatagagccaaatgtttattttattcctaattatatttttaaatacatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagattactttctagaaaaaaataatgcctgtccatctctttcctcttgggaacaggactacatgaatgcccttcaggctataccactttagtcttcacagaacttagccttcctggttgtcaaagggcaaaaggaattattttttcttttccccacgttaacagaattttcacctccgaaagcttggcgtatacacactatatgttttctaggctatttttgtggtggttgtagttattggcaaatcactgggcgtcgggggtgggttgtctgttatttctgatggaataacaaatgctctttgttttccctcttttcagctgacctgaataatgtcagattctcagcttataggactgccatgaaactccgaagactgcagaaggccctttgctgtaagtattggccagtatttgaagatcttgatactatgtctttgcttagaataaaaagtaggttgggtacatttttacttagagaggggagaaacagctgtcacaattcctgttgcaatgtataattcattctttaatgtatccttggcctagagtttgcctagaatgttttgttttatttttagaatcattcctgtcaccattcctcagctactgatgttgaattaagatattgagaatttttattttccaactactggcattggcatcggcatccataattacctttgtgaaacttgcacaatccttgttctacctttgtttttttttctttttacaaaatgtacttagtattagaagactatgactatctgatctaaaccaaacttcatagacatgtgtggtttattagcttgaatgctaacgtgcagatgaatgaagtggtagaggaaaaatgacagaattgctttcctccttttttatcatacatctgtggaaaaatcctgaagtgttacacagctctatcatgtcatcaaatagtttatgtataactctactattgtctgagggtctgtgtgcattgatgatatgcccatgaaacaggcacagtttctttttctttttttctgtttttttttttttttttttttttttgagatggagtcttgctctgttgcccaggctggagtgcagtggagtggcgcaatatgggctcactgcaacctccacctcccaggttcaagtgattctcctgcgtcagcctcccaggtagctgggattacaggcatgccccaccatgcccggctaatttttgttttttgtttgtttgtttgtttgttttgtttttttttgagacagagtctcgctctgtcaccctggctggagtgcagtggcgcgttctaggctcactgcagactccacctcccgggttcacgccattctcctggctcagcctccggagtagctgggactacaggcacccaccaccacgcctggctaattttgtttttgtaattttagtagaggcggggtttcaccgtgttagccaggatggtctcgatctcctgaccttgtgatccgccctcctcggcctcccaaagtgctgggattacaggcatgagccaccacgcccggcctaatttttgtattttttaatagagacggggtttcaccatgttggtcaggctggtctcgaactcctgacctcaggtgattcacccgcctcagcctcccaaagtgctgggattacaggcgtgagccaatgcgcccggcccaacaggcacagtttctgctctgatggaacttacagtctaacaagggataaccaggatgttcatgaaatttgtagacataagcaaatatatgtataatgtattaagaatgtctacagttggttaaaaaaataaagtgatcttgtctctatttccaagaccatttcaatgtcatatatttagttgtgcaacagtgggacaatggggtactatgtgaacagctaactgtgtggaatgagattcaaagaatgtttgtttgaagaggtgatgtctaagctaggtaactctagaagagtaagcagctctctctctaggaagagcgttctagtcagaaagaagagcatgtgctgaagggcccagagaaagcatgacacattcaggaactgaaaatatgtcagtatggctaaagcacagaattccaggggaaagatctattgtgaaataataggctggagagagaagcaggaagcagattgtgcaaggtttttaaaacccaagttaaggaatttagaggtcaggggatttggcctgggggtgacataatcagattgtcgcttagaaagatgattcttgctgtggaacagagtatggattggtgcgatgtgggagtgacaggagaaaaacctgttgcagtaatctaaaccagcaatgtggtggcttgaattagcagagtagtaagggagataagtggagagaatttagaaatatttaggaagtggatttgacaggcctcagtgattcatttgatgtggtgcagggatgtccaatcttttggcttctccgggccacagtggaagaagaattgtcttggaccccacataaaatacactaacgctaacggtagctgatgagctaaaaaaaaaaaaaaaaaaaaaaaaatcgcaaaaaaaaaaaaaaatgttttaggaaagtttacgaattcatttgggcctcattcaaagccatcctgggccacaggttggacaagcttgatgtggtgggtgaaagggagtcaaggaagacacttaggtgcttggcttggaatatcaggtgaatgtgggacttgtctggtaaggttagacacggagctgtggtgctcaggagaaatatacaaacaacgtttagggatcatgagcctgtaggtgctgcttgtaacgggggagaggattggatagctccaggaaagtgtagcgtgagaagggaagttatttaggacacaggataagcaacctacagaagggactgcaaaggaatggccaggaggaaagaaggaaaattccaagaggttatgatgccacatgctccatgggaagaaagaaagaacccgttaccagggtcagatgttgctgggatgtcagcataaagttgcggaaaatgcccattggacttagcaacaggaaggtccctagtaactttggtgagattttagaggcacagtggaagtggtgtggtgagttcaaaagtgaaccaaaagtggagaattagagaaggtatgaatgattcttggagaaatttacttatgaaggggagaagagtggggtggtagctagttggagggggctgaggagttaatggaaatgtatgtacagtcacgtgttgcttaacaatggggatatgttctaagaaatgtgttgttaggcaactttgttgttatgtcaatataggagagtactacacaaacttagatggtatagcctagtacacacctaggctgtatgggatagcctattgctcctaggctatacacctgtacagcacgtgactgttctgaatactgtaggcagttggaacacaatagtaagtattgtgtatcgaaacgtatttaaacatagaaagatacagtaaaaatatataatagtgtaatctcatgggctcgctgtcatataggcagtccattgttgactgaaatgtcattatgtggcacaatatgtgtatataagtgtgtgtgtgtgtgtgtgtgtgtatacattgatccttgaacaacatgggtttgaactgcttgggtcaacttacgtggatttttttcaatcaaatgcaggccaaacatatagtattcgtgggaatgtatttatatgagtatgagaagacagggtgagattacaattattggcccaagaggagatgataaataatgggtgttctcagagaatacgggcaggtaatccagagcccaagggagggaagagatacctctcttccactgtaatgggtggggtagagggaaggatctgggcaggtccaggtaactaagaaaccaggtagcagcaaggtgaaggatgtcttactataaaggcttccattttttgtatggagtggagagtccctgcaacgcagttaacagcaggagatgatgaagttgggcttatctttgtggagaataagagagagggcggagttgaaaaccagctgtgtgaacccagaggcggctgagtgtttcacggtagctccaatctgcaggggtgtggtatttccccaggcacgcttagcacttgggagccagatgcttctgtcctggggtagggagggaacagctgggcaagagaagtgaggatttgggcaaaagattgattaaaatgatactgacaagtccctgttgggtaggagaagctgtgaacgcatatggaaactggtaattaggaggtagagggatgaaaatgctaactcttcagggaggtaggggaagaagtagtaaaggaactgaaggtcaagaagttgtggtcagagagaatcatagatgaacattattttgaaggtggaacagtttcaggtgattagatctaggatatagccatttgagtaggtggcagaggtagagtggatgtgaatttccatggaggtgaaatagcaagttaaggaactgagaggctagaatgatgcatgagtcccccatgccaatgttgaaatcatgcagaattggagcgagaactgggcaaaagagaaggaccgtgaaccctggctgccaggtcttcagaaataaaggggttcaaccagaggatctgcagaggctagcaataagatagtcaaggagtcacttggcatatggttcttacacagagatagagaagaaatgccttagaagtggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaaaaaaaaaaaaagaaacccagaaatagaccagatggaaaaaccttataatgactgttcctttctataatgtccattttcaccctggatttaggcattattcgattttcctgctcaaaaaaaattccattcacatatgtgttttattgtctgtcatttcaacttataatttccaataaactttgggaaaatgggggaatttcataatatacaaaattttgtccatttgaggtgataaccttgtaataaaggtaagctccgaatgtagaataatttctttaaattttcacttttaaatcaatttgaaattctctgcatttcctttctgagcatggcttttctaatatgtgaaaaagattcaagtatgccaaaattaaggtgtatgtatctaaattaagtattgaattctcattaatgctaggagggtgccatatatagtaaaactatagaatgaagagttcaccccatccttttattgaacatatgtgtggtcacattacttactttcaatatatgatttaagaattttctcctaattttatatttgcttagatttagcttccaggcttttgtcatttctaagcctgcaaagccatgataaagagctattgtctgcggtacaggcaaataaaacttgccctggctagctttccctaccaaaggccacttctaccaactctaactttaaggaaaattaatgatgttatctcagtgatttcctggtgccagtgaagagtttgaattacagatgccttggaaatatgcacttccacctctattaagcacttgatcttatttttttttcacttccctatcaatgtttccgtattgcagaaagccaaataacccaattgtatccactatagagaattcactatttaagtggagagcatcaccgttggcctataatgtccccagtttgtaatcagttaagtgttgcatgactccttactgcctctcaacacattggaaatgaaaatgaaacttggtagaaaagcaggaacaaagataaaatcttggtaagaaggatttataaactgtttcatatagctgatactccattgaaagttatgaagaaggtaatttaagcattttctttctccctttgtagttctgatgacattctacaggtgtgaggcttctaaaattaaaaagccaacttgtaagagcagaaataaaaacgcacttaacaaagcaagtgtatttagtttattaataatgtgtggtgggttggagagagcccaaaccatagggctaaatatactgcagttgataagtgtgacaaatattctgcaaacagtaagaaatagagaacattttgcctctattcagcaactaaagcacacattatagagatttggtacaggctggagttgtgtgaatagtcacagtttctggactcgccctcaccatgacaaaccaggtgaaaaatgcaccgccttctctgtaaatgcacctcaccttttgatggtgcgctaagggtgacattagataggcttcagttgctaaagaagactctcaggacccacaataacatggcttacaaatccgcgctctattgccagaaaaggctacattacaagagcattactgtcaggatatggatccacagccacaggctgcctccacagcaagggggtctcgagaggccagtgtaattattttgccactgtcctacaaaaatctactttttctatataccatgtattatttttcacataggttagaggccatgtctctgttagttctgagtttaagacgtcttgaggacatggccaaactaattttctcagtttatatggtttgacagatattagtgcccaagagaggtctcataacatgacccatctatctcccaggggaaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttctcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttccctttaaaaaaaaaaaaaagtatcggctgggctcggtggctcacgcctgtaatcccagcacttcgggaggccgaggcaggcagatcacgaggtcaggagttcgaggccatcctggctaacacggtgaaaccccatctctactaaaaatacaaaaaattagccaggcgtgatggcgagcgactgtagtcccagctactcgggagtctgaggcaggagaatggcgtgaacctgggaggcggagcttgcagcgagccgagatcgcgccactgtcctccagcctgggtgacagagcaagactcggtctcaaaaaaaaaaaaaaaaaaaaaagaaaaaagaaataaaaaagtatctttggtggtttccttccccttgcaacaatctcacctttttccttttatcattaattttaagccaaacctcttccccagctacacacacacaccacacaatgcagacagtccccaacttgtgaagtttcaacttaacaattttttgatttcacagtgatgcaaagtgatatgcattcaatagaaactctacttctagatttgaattttgatcttttccaaggctagtaatatgcggtatgatactctctccccttgctgggcagcagcactgaacctcagctcccagtcagccacaagatcatgaggctaaacaactgacactttactgtgtaaggtgttgctagacagttttgcccaactgtaggccgatgtaagtgttgggagcacattgaaggtaggctaggctaagctgtgagtttcagttagttaggtgtattaaatgcatttgtgacttaagatattttcaacctatgatggggttgtgtgatagcttcaattaggcaaggcacaaggaaggagtaatccattccattgatccttgtggaatgcttgtgcttaagtaccaactaatagccatagtatcttattttggaatattaccagcctttgaaactcttaattgtagccccagttcagggactactaggtctggcatcaaaaaagaaacctgtagtgacatagggaatacctgtaagtgccccacttgaattatctttttaattgtaactggtctcacaggtgtagcccatttctcaaaaatgatagttgcttcagctttttggttgggactccacctgcaggccagagagggtgaagcccagtggaaagaaattctgaacttaacattagcttttggatttttttttagcagccttgccatcagtttgcaattgcctcctaatccattttgttagctccttaggttcaagttctctcacttccagattccactagaaagttacaccatcagtaaccaatttcaaagcctgtgttacttttcaaccaagcgtagcttgttgagcaacttcaaaggttctttttcatcccttttatcagaatcttctttttttctttctaaataatgcctcagtcatacttttagctaagaatgagttggaggtgttctaaacaatcttgcttctgacactcactgccctgacagtggaagttaaacagggttcaattgctaaagaggactcacaggaaccaaatgacagtgcttacgaatctagagttccttgcagaaaaaggatgcaatatacccacaacattaaaacaagaataagtgtcacagccacagcctgcctcacagcatagggtccagagaggacaggtgcaagctataattgccctctgtctgcaagagccacaccacgatgcattttctctcttggaacaagagctactgatgtgagcacagaacaccttggaaaccagggagcacaaattggagtttcagccagggtttcttatatcccgtgggtaacctaggcatactgttcctatgtaaccagcctcaaactcagtggcttccgttggtctgactgtgcccgggtaaaaatggtcaatgttactgttagcaataaacaatggtgataacctgcaacccatggctacacttcaacacagtaagtcactttgaaaagcaagtgctttgaccagggctctgcactgtgtagatattttagcaagtcatctcgtgccaactccagcctctctggaattaacccttactgcacagacaactacatcaaagtgcattgactttcttgaagtgcaaagatttgcttgggaggtccctcagccataagtgtaagttgcctgtagagtggcatgcctgggcaagaaaaatcagcaaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctagatatcctgccataacacccagagtgagtctccatatctctggtctcagttgtctcaactgcaaaatgattttaaagcaaccttctggctctaagagtctatcactctgtaaaagacaaaaaaaatctgtcttacataggaaggaatagcaagagttagctactgtggcatacatagaaaggaaaagaatgagcttttgaagctagaaggttgagaagatgattaggcacaaccagagcctcaggaaccattagtgggatccctgtgttgaagtcctgcctgctcgccgccccccaaccgccactgtctgcttttcctgcacagcaaagaggatcctggagagtcagccatttcttttatcctgtccccaccctctctcacccccacagccctcatgcatagggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacacacatatatatatatatatatataatatatttaatggaaattcctagcttaaggaaacaatggtttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcatggattgtgtatacctaaatggaaattttttcaaaatagctccatgaaagttgaattctgtttgacatgtttgtttagggaaatgtgctcttcagtcttctgtgatggattgttcttgtgtttaaccacatccagttttagcagagcacactgcacagtatttctctcctaactgtgtcatcttctgctcctgtaatttcagagcaattgctttgctcccctctggagctatttctactcaacatttgctgttctatgtgttacccattcacctgtacagagataagagcaggccccataaaatgaaatgcatgcagtttttctctgttcatttccatcacacggctaaataagactcttaatacaaaagtgattcgaaaaattttcactagttacttcttaaatgcctggatcagaggcaaaatatttatgatgactaaagcagagtaacaaaaaagaaaataattgaaaaacttcaaaccacccatagcttccttcagtatataaggaaacatgttgggaatattggtgtttggaagaaatccattcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaactggatagattatgcaattactttagtttgcctatagaaaattttagtggagagtatttttttcacctaatattagggtagcagagagatgctgaggtgactgatatttcaaggagaaaagcgcttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttctcaaactgagaacatttttcgttttcttttgttttttaataagattttatgaagtttcagtttggcgcctccattcatcactctctcttagagaacaattgtttgttttggattgcacacaagggagatatccccagttctgatttttttttttcttgagcttaatgaagacaattgaagaagggagcagaaggaattggtcttaattttgcctaaattcttcttagatctcaaaattattacatgcctcatttcaccaatcaagaacatactcccatttggaaatctgggaaggttttctgaaaagagttgcaaaacaactgttttgccttttacctttgttgtagacttctactaccttttgaactaaaatttatacctttttttctttcttattttgataaggtattgctttttaaaatttcaggaccacctgactattacattcatcatagtcatctaccaagtccttgaacatgtcggatttcaattgtgaactacgttcacattagttttgataagagtttgtattcaggtttcccctcaaatatattttggcactgttttctttgcagatgacatgtgaatgcattctgaatgtataacttccttctacctgactgaaaagtatttggtgacaattttaactccttgaagacctgagttgctgtataaagtggatttgttaaattttgatctaccttttcttaagagggagaaagataagaaaattttccagtgataggaatttgtttagtccattagtgcccaggatttctttttgactgagggatttaataaattttagtagctggaagttgagcatattgttcaccgaaaataaccgccattgggacctatcctttgtgattttgaagtgctaataggcgaattattctgaaatattttctcctttttctttttaccaatatctaagggccagtagctttccgtaataaaataagaagccaaaaaactattgaaagacactttttaactttaattttaggtttcggggtattatgtgaaggtctgttacataggtaaactcacgtcacgggggtttgttgtacagattatttcatcactcaggtattaacccatttatgcctagtgttccattattggaacactaagcttgtgggaattattcctatcctactgctcaaggtcatcgccaaggtctgattttcacaaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttcttaatttatgtagaacttttgcagttcaaataagggtttttaggaattgaaacttggtaaacattcagtggtcaagttggttgaatttccattgcattgtaggtcatcagtcaaagagataatgaatttggaaaagttcaaaacaatcttaataaaacagtggtcaatagagttcacacatcattgagcactttactcctttatttttccttttcaaggctttattcttaactagaagtgtttaccctctaggaaagggtcagtaattgttttctgctttgattcttcataataggggacgaacagggaggatccgtgtcctgtcttttaaaactggcatcatttccctgtgtaaagcacatttggaagacaagtacagatgtaagtcgtgtatattaatgctgtattcttttattaatgttggctaattaccctagttctagatgggaaatgacagactgttcttatttgacagcagattcctcatgtaagatgtagaactgcttttagagtgtcataaaatttggtttgtgccattccttgtcaaacattaaattgcaggcatttaagtagagaatgaggattagcttttccagtccaggtattattttacattacattgactgtgtctgaataaaacacatgttcctaggggataaagtctgattttctaacctctttctgtaagtcggaaaaataagtgtgaagatttaatctctgcacttgtctagtctttgggttcttatttaaagaataccatgtgacattcatgttcaagaaacattgtttattttataatcatcttactgcaagttgtactgacacatccaattccgtgacgtgactaacattttattatttgagagacagatagcttgctgtttcttaaaggatagatacgtaccaccctacagaatttccttttgattacgcattgggttcttctgcttaaaaactgtaaaaccaaattaaaagccaatgctagaggagtgatggttcagatgaccaagtgaccatccattcatattgtgaaaggctgcagttggttttccccttgaaatgcttataagcaatcttttcagtaggaatattaaacaaattcagcctagcttgtcttttctctcttcccctgaggcctagccacacatgtgaggagatgtgctaagcttcaggacaggcaggagataaaagccactctgtctcctactgatcatttctccttcaggagtaagccacaaaatacacaaaccattttggccctcacttttatgtagtttccacttgagttttctcatcctcagaacgagagaaaaataactgaacagcttttgttaaccattttaaaatgtatttcggatgagatgggatacctgtgtgcttttctcctttaaatattgtagttacttagtataggttaggttctaatctaccgtatatatggtatagtgacagcacattgtaaatataatattaaattgaataattgaggaagctttgagttggtgtttcgaataactactaagagggaacatgtttttaggttggtgaaacaaaaatattaaatgcaaaatgagatgtttgaaagtaactcataactttgaaaataaacacctaggtatgtatatcggagagcagataaaaagctgtgcgtacaatctcaatttttagtgccatcttaggtatcctgttaaaacatttaatttcctagagtttaaagtgtgcttatgggtacagaaagctttcttggatttactttttttgaggggcaacttctaggtgaatataaggtatgattaaaattttatatctgagaacaaaacataacattgcaagcattcagtatgttcattcattctgttacatatattgggcacctactatccaccgggtactgccattctactgtagatacttctggcacacaactgaccaagatatggttccttccctcaaggggatataagtctcctgccaaaaacgatagacacatattgaatcaatgccagcataacatgatgtgagctattaattagaaatacgcagccaggcgcagtagctcacacctgtaatcccagcacttagggaggccgaggtaggaggatcacttgaggtcaggagttcaagaccagcctggccatcatggtgaaacacgtctccagtaaaaatacaaaaattagctgggtgtgatggcatgtgcctgtaatcgcagctactcaggcggctgaggcaggagaatggcttgaacccgggaggcagaggttgcggtgagcagagatcgcaccactgcactgcagcctgggcgacagagcaagactccgtctcaaaaaacaacaacaacaacaacaaactatgcacagtatcctgtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacagctgtccttttttttaaaactgtcctttgtagctttgacattcccctattattccaaagtctagaggtgtatactctctgctaatgtccatcactgactgaacacactcttgtccgttctctttcctatcctgtcccattgctttttctctgtcgtagtcagtgccccagaaacaccctcttcttcccaaatgcctgagcactccactggtagacattcatcttgttctaatttttttttctctttccttttttttttttttttcttttttgagttgcagtctcgctctgtcacccaggctggagtgcagtggtgagatctctgctcactgcaacctccacctcccgggttcaagtgattctgctacctcagcctcccgagtagctgggattacaggcgcccaccgccaccccaagctaatttttgtatttttagtagagacagggtttcaccaggttggccaggctggtctcaaactcctgacctcaggtgatccacctgcctcgaactcccaaagtgctcggattacaggcgtaagccaccgtgcctggcctctaatttttattaggtagatagtgctacaatgaacatccttatcgtttagcttttgtctttgaagctttctttataggatcaattctcaggcgtgtgattgccagacaaaataatataaacattttttgtggcctttcttcaaaagttgttctaattgtaacgctatcagtattgaaggagtaagatgctttcggtatcacattattcacagtgttcttatgtttttgtttttggttttttcaagtgctaagagctgtttttcttatgtagggtttctcaatccattctaattctattaacaatggctgagatttacaaaatggaactagctgtagaactaactgggttatatctgaagtctttgaccacagactaggatgaaactatagaaggtttcctgggcagatcactgtgaatatttaggtgtttaaagcagtttgagtatttatttaatagttagttggatagatttaccggatgcacacataataagttcatttatgtaaagtgggatatactgtttgaattattttgccaaaattatggcaaattagttgtaaatgtaaaatgcatgtggagaaataaatatcttttcctcctcatacccaaaccttccaaaatgcagatagatgatcaatccaatcaatcatcaaaatgtagacacaagtaacttccatacaatgaatattaatggccacaggcaatctaggttcattttgattttttaaaatccaattataaaacaacttgccataaacgcgagttatttcctaatcttttggttgtgtgttttttttgttttgttttgttttgagatggagtctccctctgtcgcccaggctggagtgcaatggcgcgatctcggctcactgcaacctccgcctccctggttcaagcaattgtcatgcctcagcctcccgagtagctgggattacagggtgcctgccaccatgcctggctaattttttgtggagacagggtttcaccatgttggccaggctgagctcaaactcctgatctcaagcaatccacctgcctcggcctcccaaagtgctgggattacaggtcctaatcatttttcccctttagtcaagtctcagttactctttgagttctagtgaaacacacacacgtgttcatatatagggatatataaacatatgtgtgtgcattgtgacttgggttaaaggtaaggctcagtgatggtccctgctgcaaagtaaactaggctgtattcagggccagctggattctttgttttctcgcccgagtactgactcatcaggaagccaccaccatcctcactgcagcctctggccctcttggatttggttgtcaggataagcggtggccatacagaagctctgctttccctgggctgccccccttatcaggagaccaacctattccatttctgcctgctacatccttttgctggataacctcctactcccctaagcccatgtctctggtttggttacatttctgtctctgtaataacaactctgtattctcagtctcaaagctttgaattcagtccatccttgcatatttgttgaatgcctcctggttggccagccagtctccaagctctttgaaatgtgaaatgtgttttgttttgttttcagaaggggtctaacttcgtcacccaggctggagtgcagtggcacgatcacagctcattgcagcctcgacctctgggctcaagtgatcctcccacctcagcctcctgagtagctgggactacaggcatggaccgccacgcctggcatttttttggtgtatgtgtgtgtgtgtgcgtgtgtgtgtgtgtgtgtgtgtgtgtgtgtgtgtgtgtgtacagggtctctcgccatgttgcctaggctggtctcgagctcttgggctcaagctgtccacccacctcagcctcccaaaatgttgggagtacaggcgtgagccacggcatccagccttgaaatgttttctatgagactggggggaaatcagtcaagatatgaatggtggtaacaggtggcttttgattttctctgtactatttttattttctgagttttcttctttgaacatttataattagaaaaaaaattagtaaagtgctgcctctttttttagggaaagaaacatgttttgtttgattgctttccattgccattcttacattgtttccaggccttctcatcattgcactggcttcctagcaagcctccacttcacactccagtccttttcattggtcttattgccctcatactagttttagagaaaagcatttcccatatgatgccgtccttgaaaatgtcagtatctttctgttgtctagtgaacaaatcctaattcctctatttaactctcagacctttcctactctggtttcataaccacccatagtttgctttcactatcatgaaacagcttctccttaccatttgtacctattatgcttataaataatattgttaccattgctactaacaaaactttgttcacatgaattctctcatttaatcctcaccaagtctttgaggggaacagaatagtcaggctttggagattttgcttttattattgtttaagtggatgaataatttatttgcgcccttaaagtccctcagctggtggaagggtttgattcctagtccagtatgcccaccgccacatttactacctcattcccaaatatgtagtttctgatacttctgctctccagcttcccaaggccaaacaacagctacttttcctgagtcctggatagaataagaaaaggtataacaagacaggggacccttgagggggaagaggaattagtttgaagtgctggcaaatgtagtatttctaatcagatgctagtaaattccatatgtatggcgaggctttcattacttagatttggggagcctctcagcgttttagcaatttgcaatcaggttgaatggatccattgtaaatacttaggaatacttaggaatccacgtcctggccctggcatgcttttcctcggccaggtgcactggcggtcaccttgcctttcattgtgccacgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacatacatgcacacacacccatctttattgaaaatactctaatcccaacatagctgtttagtctatcttcagataaaaccaagtatcacttttaggtgggaaaactatacagtcatgtgctgaagaatgacgttttggtcaatgacaggccatatatactatggtggtcccataagatcaacgtaagaagagattataatggaactgaaaaattcgcattactttgtgacactgtagccattgtaacatcatagcacgaagaattatttcacaaacctgcactgccagtcatttaacaggtaaaaaagtatgttttaaaatatttttaattattatggacacataatagtactcatttatgggttacatgtgatattttgatacaagcatacaatgtgtagggtaacacaatcagagtaattggggtgtccatcatctcaaacattcatcatttctctggtaggaacattcccatttcactcttttagttattttgaaatatacaataaattattgttgccatgcatggtagcacgcacctgtaggaccagcgtttcaggaggctgaggtgggaggatcacttgcgcccaggaattcaaggctgtaatgcacaacaattgcacctgtgaatagtcactacactccaacatggacagcatagtgagaccctatctgtaaaaagatttaaaaatatattgattactatagtggccttattgtgctaccaaacactagatcatatttcttcttactgtatttttgtacccattaaccatcccttttttatcccccgatcttcactacatttcccagactctggtagtcatgattttactctatctccatgagttcaatttttttttttttttttttttttagctcccacacatgagtgagaacatgggatacttgtctttctgtgtgtggctgatctcaacataacgtcttccggttccgtacatgttgctgcaaataatgggatttcattttttatggctgaataatattccattatgtgtttatagtacattttctttatgcattcatccactgatgggcgcttaggttgattctatatcttggctattgtgaacaatgctgcagtcaacatgggagtgcagatatctttttgtggtttcgattttgtagtatcttcttcagtaaacattttaaggactttattgtttagataacgtcaagtataccaactttatattcaatatgcttcacctatgagagctggagtgtcaaaatctgtttattttacatctgttttctgcctcctgttgtacttagtattccaaatgagtaagttgcttttccatctatcttctgaatttctctatttgtatgacaaaaatgaataccatctatgcacagttgttgtaataatgtagaatgatatgaaaatgagaataaattacagtctcaactgttgagaacaagtatttctctgtgttagaaacattcccaattctactcttttagttattttgaaatatacaatgtattattgttgccatgcatggtggcatgcccctgtagtcccagctactcaggagactgaggtgggaggatcagtaacacataaatgagaaagcattccagaatatctggagaagtgactggcagagtggttaagtgcataggctttgaaaccgaactgtgcctgagtccaaatctgagctctgctatttgctggctgtgtgactgtggacacatttcttaaccttcctggcccctgaactcctggaggtgattgtgaggattaaatgaaccaatagaagcaaagcacttaagagctgtagtggatacatagaaggtgcccagtgaatgttagctatgattatctaaagtgtgttgtggcatgaaaatatcctgccaatgttaacagttgcttttatctataacaaaacatcatctgtggattgcattttagagattctggagattctgtttctctgcaaatgttaaaatgccatatcaggagacttttggctggttagacagcattccccgggtcaactgattacttttttttttttttttttttttttttttttttttttttttttttttttgagacagagtctcgctctgttgccaggctggagtccagtggtgccatctcggcacactgcaacctccacctcccaggttcaagtgattctcctgcctcagcctcccaagtagctgggactacaggcacgtgccaccacgcccagctaatttttgtatttttaatagagaaggtttcaccatgttggccaggatggtctcaatctcttgaccttgtgatccgcccacctcagcctcccaaagtgctgggattacaggcatgagccatcacacctggccgattccattttattaatagattttccatcctgaaagtaactcctaaaaaccctccttcacttaggtttcctttggctttttgtgtattaatcagactgtgggccctttggttccatagacattccttttacaccccttttggacggatgaatactcactagtaactaagtaattagtaagagttactacaatttggtatttataaagaggtggcctttcccagaattgaaggtagaccctaatagtccaatcagccttccatagagatagctggctgccatgaaaagctgagagatatcaccgacctcttactgggcctgctcatgaacagttagttaaaattcctgcaattttcagaaaagacccttatcagagtattatcagtattgtcttaagtttaatattggtttccagttgttatttttaaaaattttaagctaccgtgggttaagctttatgatgatctgtttaagtggtttgtttgattaacttctctattggagtaatggatgttttcttcaccagaattttgaagataggtttgtgttgtagttgaaacctgttttgtttatacacttactgctaaggaaaagcacatgtcattttgttttccatcttcatccttctaaagtagcacttcattgttatgaccaaatctttctttcttccttccttcctctcaccctgtcttttccttccttccttcctgccctccctcccgcctctcttcctttcctctcctctcctttcctttctttctttcttttctcttttctttcgttctctctctctccctccctccctctctctgtccccttctccttccctccttccttcctttcttccttccatttctatcacccctaaaattccatcatgctgtatcatctcactaagtcccaatctctggaaaccacagctctgttttctgttcctgtaattttgccttttcctgaactggattttaaaggattgtaggaggcagtagtggaagagctaactttatatcttgttcttttacataatgcgccctgatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggtagttatgggaagccttttacttcttcttgtctcacaaagacaactcttgacctctcaatccttaaacaaaaagttctgcttctgcgcatgtggggactcttaaactcattttcatgcctggagattcacatttagggatctaggaaaagcacatctaggcagagtcgatgaggagatgctttaagaaccgtgacaaggacaggaaggaaatcaattttgcgttaggtttgtatttttagagaaaacgaatcctggggaacttttcacactcattactattgacattaataccattgtcctgtccctttcacagttactaaaatcactcttgcccaccctcctgccttgcccacaacctattcccatgaaggggtgacttgggagaaataacggtttccaaccaacgttttattttggaaacatttcaagcacaaagagtagttgaaaggatagtctaaagaacactcatctgtgtcatacatctgttcaatccatggttgcttttcgctctacttacctcctccaccctctcagctctgtttatgtatgtgtctgtctgtgtacatacacacacaaacacattttcccctatgccatttaaaagtaaaggagcatcacaacataaacccctaaacacttcaccatacaccattttcttaaaggatgacattctctaacataactgcaatgctatcgttacacacaaatttaacagcaatccagcaataccctctgatatgcagtccacactgaactttccccagtgccccagaattgttccttatagccactgttttcttccagcatctagtcaaggtttttgtctgtcatgtctctgtaccttcatttagttttgaacagtctcccagcattttgttttcctttcatgacattgacttttttggtagggggacagagtctcgctctgtcacccaggctggagtgcagtggcgcaatctcggctcactgcaacctctgcttcccgagttcatgtgactctccacctcagcctcaggagtagctgggattacaggcatgcaccaccacacccggctgatttttgtatttttagtagagacagggtttcaccacgttggccaggctggtcttgaactcctgacctcaggtgatccacctgcctcggcctcccaaagtactggaattacaggtatcagccaccacgccgggctgacgttgacatttttgaagagttcagaccagttctcttgaagaatgtcccatactctgggcttttctgatggtttccttgtgattagattaatgttaacattttttggccaaaagacgataagatgatgctctgtacctaccactgtatcacaatctggaggaacaaaataacattttgttcctattggtatcactaagaatgttaaggtggtgtctacaagatactttccttgtaaaatatccttttccctttgtaatgagaaagtaattttttgatattttgacatattataatatccattccttaaccttttaccctatggttttagcatttatggatgatccttgtctaattcagttataatattggtggttgcataatggtggctttctaattctaccatactttctgcatgtattagaccattttcttatgtaaagaagagcttctacctctcccccgtctattcatgaatatcactgtggacatccaaggtggttctgagtgtacaaagaatgatatctctctttactgaactgccattggatactatttttgtcttggaattgtttaaaatggcagtgtatggaattgaaagtcctttctccagagagccacataaacagatgtctaataaatacatttccatattaaccaatccttttatgggaacaacacattgacataattaaaacacgtaacatgaaaactgtgctgaattgagaagctcatagagttttgtttcttttttttcctttttgccacttcaatatatatggacccgcacctgtcagtccaggtagctcatacatgccgtagcatctaatggtacgagggacatgtaatgctgaaaagaagggggaaaggagttgatcagatgagatataagtatgcatttatcagtgttgtggggtattcacttgcaccttccattggctctcgcagccatgttatcggcatataattcagttgaagatttatattcacctggaaattgtcctaagtgggccttgcttacttagctatcagactctagtactttcaaacaaattaaagattcaaaagattttggggatcgccttgctttttcccataggaaatcacttttgtcctgtctttttaagactattttaagcatatatttcagtattaaaatcgtagataatcttaagctgtttccttaacctctttgggccttttcttatctgtaacataaagttaaaacaggttatctcaaaagttacttatccctaagtgtctttgattctatgctaaatgttataaaggccgaaagggaaatggattattgtacttatttcaaagcttggccatgatcagcaaagtcttacctgatcttccgggtaacaactcttgtatcagagctataagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacatgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcaccccctccccgccctccccctcccccccccccccccccccccgcccagttgtgacaaccaaaaatgtctcccgtaaaagataccaggatgaaatcactttttgtcagtcccaaactaactagagccagggcagcatgaaaggaggagggttcatggttacatgcctgagataaagactgtctcaaggactttctaaaatcgccccacaagaaattcctctgttaggactgcagcagtgcacgtaatatgctctcaaaagaacatctgcccagtaatggcatccccactaataaactgacaccagttctggcgttgagcatctgaaacgaactatgtttccaagcagcttatgtaaacttctgtttttaccaataaaagtttccctctacagtctcctcttcagatgcatcttgggttgtaatcctcatttctaattccaaaataaatttaacatatttggcgatgtttttctctgatgttttttggtcgacactccaaacattgttatatttcctctggggtacggcatcatttccggttgagaaccaccgacctagagaaaagctatctgcctgtgcagttcctttcaagggccccaagtgtgaattttgtgtatacctatattttaagccagatcattctgtacataccttctaagtccagatgaagtctgttagccttttatgtgtgataccatcacatagaaaccaacacaaggacatttactgtaatcgataaaggaaattttggacagtttgagaaagtaacttattttgtcttctgctctttataaaatctttacaagtgtatgtttttgctcttcaggatgactaggcagctttttaaaattctgacttcatacagattttataatcttccttttatttcttgcgatcatattgcagttgaattcccacccactgttcaattcagcagattttaacagagactccagaagtatagttcctgtctttaattaatctgcaatttaggaaagaaattaaggaggtatcgttctgtattgtttccaggatggtggtttcttgttatctgagaattactgggcacagtctcttgcccaatgtttacttctctatatagagttgacccttgaaaaacatagatttgaactgtgtgggtccacttataagtggatcgttttcaaccaaatgcgtatcgaaaatgcagtactcaagagatgtgaaacctgcggatatgcgttcagctgggcctactgtgggacttgcgtatgcgtggattttgctgtatctcaacagcaaaatccccgtgggagtggggctgcggcgggccaggaagcaacccctagcatatactgagggatgactgtactaattattgtagtttattaagtgttcacatggttttcacaaacctcacaattgaaatgccaattgccttctcctaaaaaatacaatgtacgtgttcatggtagctgggatgcagggcttgctgagaaatacttaattgcatttcttctgtagccatgaattgattttattaccttgagagaaaaatgagtattcaggtggacctcctggcaggcggttggcccttcagtgtccaaggatttatagaaagcacaacatcaaagaaatccaaaagttcttcggaaccccagcaactctcctacctccaaacttgccatgtaatgcccttttaaacttattatattgataggtaaatcggtttgctagaaattccagatattgagaattctttgtctgtgtaccttgttatatttgtataaaggtgatatttgtatgaagccaccctccagtgtgctgtaacagagcaatagtaatgacaactgattccttcccctagcttttctgttatggatagttgctggcaggtgaggaccaacagaaaaagaggagaaacccaacataattccaaactgtgaccatcataatggaaggagctgtgatagctttgctttctgtgtgtgcatgacatagaaggggaaaatggagttattgccaaaacaacagcaaaagcaaaacaaagccaacaaacaaaacaaaacccagggctaaatgacctttccaagagattttgcttgcatggcttgaaactggtgtttagagatgaggacaaggtcacccttgatactgagaggggattatatctgagacttatatgtatctcaacaaataatggtacttacaaagattatctcagtccagtgaatgccatcatacttatcttttgaccttaataacttcctgctattccaatctatccctatatatttttttctggaatgatcgaaatgtaattttagctgggtttaattctagttctgttaggtctttacagaagcttgcctggcttttaattctttccttcttcattgccagacaaaaggagagggaatataccactaggatacagagtagtttgtcataaaaatgaaagattgaaacagaatgagaacgtgaatccccgtaccttgtcttcagtctgtcagttggcgtaggtgagcagttttaaaagagccaacatgatggatcttgcatcttaggggctagaaatttgagaatgttcaacctttaagcatagaagaatctatagttttttgaaagagtagaacattctacagcctcccttggtaattcacactaatgctttaacaactttcagcatcaggaaattcttccatatgagctacagcctaaattcttcatgctgcttaagtctgtttcttcttgttctgtcctcagtggagagatcgaacagctggtcacaggcccctatgcgagagccattcacataattgaaaactgttattaaatcgccccttcagaagtcactcttgcttgttctctctctctctctctctctctctctctctctctctctctctctctctctctctctctctctctctctctgagaatctgggaagattccagagctgattaacatgttgctttactgatgaccttctcagcttttaatatgttaacgtgctctaagaattttaagaggcagatataatgtgcactgtttctttcattaatttgaccttctcgtgaagcattttgctggacgattgatctgctggacatactgggaaacactgactcagagattttagttgagtaggaaccgtgtgtgagcctacggtacagaacaaaagaaagtaatccagttacactgtctggagaaatagaggtacattctccgcaatcatatttgaagaatagttttctaaatgacaatggcaaactaagccgtgtcatatgaagaagaagtaaaaagaataggaatgaagaggcatggacagataagacagctctggtaaaatatttaaagggctgttcaaagaccaagaacttctgggttgctggtcagatggataataataatgacaataacaatagcaaacatgattcttgctatgtgtcagacacggttccaattgcctttcatttgctgactcacgtaatcataaaataactctatgaggtaggcactattaatatttccagtttgtagcagagaaaaagtaagacacagagagataaagttattttcctaaggtcacacagccagtgagtggtgaactccagtggtttaactctggaacttctatatgctgtgctgatggatttcagctcaatgtgatgcagcacttttgacaggggtatctggacacaggtgttcaggatcaccttctaaggatgtttcccagctctctcacatgggtggtgtagtggctgtaagcacacactggcatgggtaagagtttggactcgatgaatgctgagtttggactcagtgaatcctgaaagtcttacagctctgtggtgccatgccaaaaggatgaatggacttgcatgatctttttcatttttagattgcataattctttataaacttttttttccacaaagtacctctgtgatggaactctacacagagaaaagtgctcagcaacagctttttaaaatttaacttgtaagttcaggggtacctgtctaggtttcttatgaggtaaacttgtgtcatgggggtttgttgtacagattattttgtcacccaagtattaagcctaatacccattagttattttcctgatcttctccctcctcccaccctccatcctctgataagccacagtgtgtgtttttcccctctatctgcccatgtgttctcatcatttaactcccacttataagtgaaaacatgcaatacttggttttctgttcctgcattagtttgctaaggataatggcctccagctccatccatgttcctgcaaagaacatgatctcattcttttttctggctccggagtattccagggtgtatatgtaccacgttttctttattcagtcttccattggtgggcatttagattgattctaggtctttggtaaacagtagcatttgatcggaagtttgaactgataccattttgcagctaggaaatccaaagttaaacagtttattatagtgttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaaaaaaaaaaacaaaaaacatattaagcacacaagaaatcaaggtggaaaaagaaagaaatcaaggtgaatgagaaccagaagaaatagcaaaccatagaagcagacctacgataacatcatattccagaattattagacagattattttcttaattgtgtttatgcagttagaaaaataaaaaacaacattgaaaaatatctacagggaaccacaaacctgagaagttaccttaaaaatgaccaagtagtatttctagatgtcaaaagtacaataatcaaaatttaaaactgtatgggtttacagcagaccggcaagagaaatggatacccagacagtaaggcagaaggaattaataagaatgaagcacagaaggatgttttaaaaagatgtggggcagagaggggggaactagggaagtcctgttcagagaaatatagattgaagaagagtaacatttatgtaacagagttctgaaagtagaatggagagggaatggagaagaggcactatttgttgagagaatgacggagaagattccacagctgattaaagactctaaatcacaggtttaagaagtccagtgaatcctaagcagtctaaatcaaatcctagaaacagcacaagatagaaaacagatagattatctttattttttttattttatttttattatactttaagttttagggtacatgtgcacaatgtgcaggttagttacatatgtatacatgtgccatgctggtgtgctgcacccactaactcgtcatctagcattaggtatatctcctaatgctatccctcccccctccccccaccccacaacagtccccagagtgtgatgttccccttcctatgtccatgtgttctcattgttccattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcaaaggagcaacagtcatctttactattgacttctcagcagcaacagagatagacgaaagtggagtaatatttcagtattcaaaaacaaaataaaaacaagaccccaaaacctttcaatcaaaaattttatacttgggccaggcgcagtggctcacgcctgttatcccagcactttgggaggccgaggcgggtggatcattttaagtcaggagttcgagacctgcctagtcaacatggtgaaaccccatctctactaaaaatacaaaaagtagccgggtggggtggcgtgtgcccatggtcccagctacttgggaggctgaggcatgagaatcacttgaacccaggaggcggagattgcaggagccgagatcacgccactgcactccagcctgggcaatagagatagagtcagtctcaaaaaaaaaaaaaattgtatttaatgaagataactatcaggaatatggattttttttttaaaaaaaggaggtattttcagacaaacagagcttgagaaatgcaccaccaacagctaaaggaaattctaagggacatatttcaggcagaactaatcccagatggaagatttgagatgaaagaaagcaatgaagagcaaaaaagtagtcaatatataggtcaatctatctaataatataaaaaattaaaacaatcctatagggttgaaaaaaacaaggtataattaaaattcatgaatatagtaacatataaatcaaatggtggtattttgagattgttgagatcattgtcctgtctgggatgaattgtatttcttacatttagactttgaaagagagagaaatagagaggcagacagaatcaacagggcatcatgaaaacagcgctaagccaggaggtttggattctattatcagctctgctgctagctgtatggcctttgaaaagctccttttctggtctacaaaatcagtttgcttgtctgttagatgaggctttggaaccagatgaattttaaagcccctcattatgattctatgagaaacagattctctagaaaaaaaaatcagttgtccccctcctttgaaattttatcagtaaacacctgcatttcacttctggctaacttttatgtatcagttcaaaaattaaagctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactcttttccagttacgtgtgaactggttttgttactttattttctaataactaccttgtactgttgcgtgctttttattcatagtgcttttttacttttggtgtttattgttccatagtcatgctgtttacaaagaggttttacaaaaacttttagaggtttctgaagcctagatagacaacagtgagtaggtactgcttgcaaaggtcaccttctttccttcccggtttcttggcaggtaaaaatgataccatgggggtggggagtggggaagggaagccacagtgactgcattagatttctaagctaccttttctctgcttccttagctagtgggctttgtatacaagggaaatttttataaaataaagaagaagaatgccttggaggatctgaaagagcactttcaccttcaattcttttgcccttatcatattatattattttaggacccagcacttctcattcctcctgtccccctcttgaaagatggctggaatctaaaaaagatagctttccttcccacttccccatatgtgacataagaaatatgtttatttgaattggctaaggttcttatctgagaaagcaaaaggcaggagagtatgaaacaaagaatatcgcattctgataatggaggaaatgtaccaactagtatttacagattataaattcttccatctaatccaaatttcatgttctcttggggcttcagttatcatttgtaggtaatggggtgagagatttctgaagagatagagataaaagagttcattcgagtaactgtttgaagatgaatcgtatcagtcaattagaaaacattattaaagcgagacttgttttaattgaaagttcttgttcacatttcttttgtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgtttattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgagtttggttgaataattttaatgaggtgtgcggactgtttatcaggttatgccatgctatttgactaatcattatatacaagggtttctaaattttgaactaaactcactttgctctcctctccaagctaaatattcagctcataaacaattatacatttgctctaggaggaaagtatttctttgttattactattggtgtgtattaataatactgagcttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgttccaccatataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactgaagtctgtgttttctttaatagcagtaattgtatttaaagtatttattcataggattataaatactgtataaaatatattacaaagccatcctattcaggcataagagccaggtcctaacgtgtttcattttgcaagacttgtatctaatgttaacaaatcctatgatgattacaatatttgatccatttgatatggatcacagaatttgaaagtttccagagatacagaccgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatagagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactcccttttggctcattttctggtttaataaatgtctcttttagtgtatattttttaagatttctggttattgtaagttcttgtgcttatgcatgctgtgataggcgccactgatattaataagaaaaataacatggaattatccttgaggcaaagaattaaagctctgtataagattttctgtataaaatggtattaaagtattttggatttatatgcctacttttcttggtgtacttatgctccaaggtcttaggctttcattcttgtacacacttccaggatagcaactattacaagggaaaacactactaatgtattttccctgatggtaggctttttgcttattaaaaaaatatgtaattgaaagactggtctgttccaaaagatagttcttataatacaaataatccaagtattaatttatcttgatctgcagtgaagatttcaaaacagaccttagcatttttctaataatgggctatgccagggttctagaagattaacagattaactctccaaaactatagtgaagtttcacatggaaatctttggatctgcttattaaattgagtagtcatcgttttgtttcctcttgacaatttaaacgtctttataactcatttcaatttgattatgattacacttgacctagatgacattggtttcataaataagacctttctctctcagggaagaattccatttccctagttatttgctatagtgtgtcgtaattatcttactgtagtatattaagaaatatgaatttctggcacattttctaatgcaagcttagctactggtaactgcatctttttcttttttaatgtaagaagaaacaaacacattctccttagtgtttcaaccaagtccttcaacgctacttggacactgggctaaaccagggtcctctctgaattacattatcgttgacttttggatttatgcctttacctaagggctttctgtgtcagcagagaaatggaagagaccttttgtgctattccaattaaaagaaaaagtccaagcctaaactggttttcagaacagatggttttttttcctaaggttaatccaaaagatactataaaaacttcaaggataattaatagatcagatatgaaaggatgaaaaaatgttaaccctaccagaattctagcctatggagataagaaaagataggtgtttatatacaaaaagcatatagactattcctgctaatgatctcctcttattttctcacctatgttttagcacacagtatctctaagaaatatttcagatatcatgacgttctatgaaatttagtcattcttttttaaaacctcacaatataatccagggtcattctattttgtgctagaaattagtggtatagtcttgctgctgaattggaagatacatttcttctttacaaaattgcatagatcaagacatcttgatacatggagttttaagaagtcttgtactagagtagcctctttgaagctaaaataattgtaagtatctaggcagatatacagctttgatccaataagaagatagcctataaatggcgcaggtgtaaactatttaaaattttaaaccacatagggctaacacaatttcggaattataggatgtgagaaattacaaagtaggaggacaaaatgcttcctagaaactgtctcccccaaccttttctacgatgggaattttccagagaagattttggcctctcttcatggcttttaataaaagcagaagtatgagaaatcatctctcaatcctggattttaaaatacttgataatatttaagatataggagcaactaaatgtatacattatccatagaattagaataaaagcattctaggccatgtgtataacataactgtgtggtgggttttttctccattaatggatggtatctgtgactaatcacattttctgccttataggcctgcctcgtcccctcagctttcacacgatgatactcattcacgcattgaacattatgctagcaggtatgagactagttgtatgccaggcaaatattgattgaaataactaaccaaggaaagctaacctatgatattttaaacaaatcttttctttttttccccaaacttgtctgattcctactaatcaacttgccctctaacgtgcatgccgttccactgcatgttgtttttggtcaccaacaagagcattagtccagaataatcttccctaaccctggcttttaaacatttccggtagccttgctatgtttttttatactgagcacatttactaaattggcttacaaatagtttaacctccttagaaaactgctagaccagacattcatatatgaaaaaatgatactatattatatggagaatatgaaagcatcagctttccgtttgtgtatttattttacatgatatgctgtaaagaagagaataattaattttcctaatccttggacttttctgtctcaccttctttgtgtttgagatgatttttatacctaaaaactgaattactaattttaaaatattttatgcttgttaaatccgtaagagtttggttaacttttttagttgtaaaaaaacaaacaaacaaacaaacaaaaaaccccctgtataattgcctgaggtgaagaagattttaaaggtaaaaattggtggcagaatgtttagagagcttactgtgcatccatcctttgtcaatattctaactgctggacatgtttaccaatcgtgaaaagcattagctagctgtgtaagtctgtcatcagtggaaagtagtaattgtcctaaaagacaaggggtagtgtaaggtagggagtgcacttattgttagggaagcttttcttctgaaaacaaagacctgttctcagtgaaagcaagactgatctgtagggggaaaacagtgaaatataactttccttagaatttctatcataaatgtagtgctactaactagctgtggtctaccacacactgcctcaaatggttaagccaacacacacatcctttaatttgaaggattcctttctcttcttgccatgatttatcctttagttttcaggaatgttcgattaggtcttgaatagattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactttaaggacggagatagagcggtgctaagagcagcagggaacacagctatggcagggaaacaggcttcattatagagtgagggcagtgttcacaatacagagcacaaaggaacattgccatgaaccaagtaaatgctgaccggggcttgaggtagagagagcagacattgaagcaaatatgaaggaaaaaataaggatttgccaagtgaataaataacataaagagaagaaatctagtcaaagtattacgatgcctttttagtttgataaagtaaggatatctcacccatcttggagaatatagacaaagggaagaatggtaaatttatcatatgtagttggtgtggcaacacaaagtcatgctcagatgagaaaagaaccttcataaggattaggccaaaagaaatagtatcaaagtggcatatatataactagttattgaagacatgagaataaataatctcatctggtacataaacgatcaagctaataataaagaatcaagtcaaccctcagtcatttgtatatgacttacttccttcaaacaaacaaacaaaaaagcctttccccaaccataactgtgatgccttatctttcttagctatgggaaaaagtattaatggtactaatatataagatacttcaacagtaaaatgtgtggccaaagaatcagccaaatgtaaatagcttgtgcttctttggctcactgattttggtattagaagctctagcacattcagattaattcgagttgtatctacgtaacagtggctgtcattcattgactgcctaagagaacaggaagaaaagtgtagttacaactctaggttataattaaacatgggaagttctagcagtacaacttcagaatttggaatgagtgtgataaattaggtggtaaaactgcttttgttttattttaaaataagctttagcttattctgaggacataaaatccattttgactcaatgttggatggcaaaaactcatggcattttaggggcaggtttggggaagtggtttggtggattggttgacttcacttaaatgtgtgtttttaatacccaataattatttttagtcagcttttcacatctaaaccaggtaactggcttgataaacaaaaataattcaaatgagaaggactttttcctaaatttctgatatttttcaacttaagtgggtatggagaggagaatattagcgtatcatcttaatgatatctaaccagaaacaatgagctttagcctgtcattacggacagaagaaaattcttataacttggaggtaaacaggcctttccggagcttggagcaatgcattcagaaaaaagtttgtcctgtgtattagagagttcctagtttccaggaaagattgtagctgcctccccaaatagaagcctttttgcctccttttcccgcaagattagtccttaaaaccattatgtataaatttaaaaataaataaaacttgtatttaaaaaaactctgccccgaggaatgagatgttcagtcttcttttaatcagtcaccttaatgtcttttttccccttaattttcgttcttctgtctaaacaataactgaatgaaacaatcatgtatctccagtttaattgttgttgtcattctgcctcaatgacttatataagttaaaactgacttactgaagcaatactttttggttacattgccttccacttaataaaatatttcctctgttacttttagagctgcaaggtattttttcctactcagtacaacaatagcgtgggttagtgaacagattatcttgacaggcttggtggccaaagcattatacagccattattatatcttttaatattttttagctattgactaacatcaacgtagagtcccagtatttctgtaattctgcctttcatttatccgtgtaaataggccaatcaatttcatttgaaaatctgagcaagaaaacactttgaattggtaccagtagaatggtagatcacaacctcagcagtatcaaaaggtctttagaagcaggaaaaaaggtctaattaattgttaagagcaaataaatgtttctattttcaaatacactcctgagtccctaacccccaaagcaaaataagggggggaaaaaaccaaaacctttgattttattttccagagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggtgagttttctttctagctttgtcattggtatgcagagtgcatacacttgcacacatagaaaagtgccaggaatcttcacttagagtcattttatgtctaattgttttctaaaataatctgtttagctccatttgcagattctctctctcttttttttttttgttatctgaaagaagacaatggatgcaatagtatgatgaagaactcatattttaggtgtgaaggagttaatgctgatggtggtatttgacttgttgcatgtgtctccaaggctttgattttatatttcagaatagaatttaagaaaaaagtaggttatttaattttatgattatatgattttttttacatgtgtttggccatattatctacctcaaacatttaagaaagtagggttattggcttggtcatattgggaaaccaattgtttcatcttatttttcatcatcaaatgcagaaattattatttatgctcaccatcatagcaggttagtgagacaattccaattgtcagccatcacctgtaaaagacagtcatgtaaaaatagcagaaattgtagaagagaaaaaggctaaagaactctcataatgactgcagggaggacaaagatgtaaacatctggggtactgtattgtgtcaggataatgcaaatcattggactttcagttctgtattacatttattatgtcacaggtcccttggtttaaaaagtcttctcacatgatcacttctaactcacaatgtgccttcttcagacagatgccaccaagcaaggatttaaagtagatgttgctcagatttgtgggtcttaagtactttcatctctttggttgagcccaaggcaccaaaagctcttaacgtaggcaacgcagtgtgtctgagatcagtgccctcgggagtatgccacttcaggatgaaaaaacaaactgccactcttccattgcttcctgctgccactgcgagccttctagctcttaacaccttttacctatggccatagctccttatctggttggcttccctttagtctctttcccacccttgcaataaatcctccatactgactctacttgtacatcttgccagaaccaagacccatcatggcattcccctttcactggatttctgcatgtagaaaaaaatcaagcttcttagtggggcgttcaaacccttccacaatattctcttgacttgctttttctatgccatcttcttttgttctccctgtgttctggctatgctgttgtagctagtatttctgaatacatcctgctctcatctacctttggggtcaagctcaagcttgagtctcagcctaactgctaacctctaacccaccactgccgtatctgacaaaggaatcccacctatcctccatcacactgctcaaaataactttccccatggagccctgctagatccctgcagttggaagaaatctgtcttttgcctctattcccagagcactttggacctttctcagaaaattccttgacagttttcctttttatcagttattaccagtgcctctctttaatgagctagtgtgtgtctttggggcatggactgtatcttaatcatcttcatatcctccagagtacttagcatggtttgaatatttaatggctactcaggaaatgtttgctaaaaacctgaaaatacagcaagaacatcacatgagtaccatccacgagataatattgaactttttttgttgttttaatgatagctttatttttggccgtacttttgagatcatttgtcagtgaagaccatggtagagaaaacatttctactttattgagaataatcagtaatatccatttatgttaaatctgtaattattgtaggggtcaaagtcaaatcggaataaaaagttggaactgacactgtaaatagaatttgatgttaccaaggagtaaatatatttttgaagtatatgatcgtgtaatatatcttttgagctcattggtcaagagccctgcctcgtttgtggttagcatagtctttctccgtaccattgcacccgggtcaaagaatgtttgtaaagagtactgataactatcatttatttatcattttatcattttgagtgcacttttacatattttagatcatttaatcttcttacaaacgctatggagaagagactgtcgcctttctgtgaatgagacacaggttcttagaggttcacacagcttgccccagatttcccagtcagccagtggtagaactgaattgaaatccagatttttctgactctaaataggcaactctgccttcaaccagataataaagaagagtaagtctctgtgaatgtcatttacatagaattgcggcatattccccagaatgtgccttaacttgagggactatctatgaggactgagtgtcccggaataaacctgttcatctacttgtggcacagcgataaccgctttaccctggaagatatccaagaccattctccaagaatgggatggtttgttctctaaaagaacaaaaaacataacaccaggcctacttagagctccaaaatgaggactctggggttgatgcaaatctttgtgtaagttaccttgaccttcacgaaatgatcaggatgagcttccttcattgtcccttcattttgtcctatttgaccttctaccaaattccaaagaaatgtctccacagagttcccttcctgaaaacagcccgtgtgttttctttgatctgccctgtcctgtcttcttgcagttctgcgcaaggagcttcagagccctagatttgccttcgctacccttgaattcagtgttgcttaaggagcctttaatttgccatttcctgttgagaaaacccaggaattctttagatgccctctctgtgcatgtctagctggctatgtcctaagtcagcattgggctacgcaatctgacaaatacgagcatacttttagagaaaataagaaagtatatttaaaattgagattgccccaagtcctttggatgtgtacttattgatctgttaatatatatattttatgttcctttagctgtgatttatctccaaataacagcaaaagagagaggcctggagagccccattcctgactagatatttattaaattccattaattgttcttattcatgacacctccctacaaccccctagaaaaacagaggatggctgtttgagaagtgtctcagaggtatcttatctctgcctttagaattccatttctcctggttgttgcacatagtattcaataaatatttgttgaatgcattaatgaataaatgaattgaagctgaatttattttaattgtagcatacatgcatgcacttttgactaaagttcttttacaaacctaatttcgtagagaaaagcctttcaaagactttgttttctgcttgcttttcaaaattctcccctttttcaaactgccttgattagcaccaggcatggctttgtcataaatttagaatgttaagaacccgttttccaaatcacaggcactgtatgtatcccacattggtgttctctgattcttggttgatgccacagagataaggctaaagctctgagtaaaagctaaatctgactgagtttttcccatagtgcctcccataagtttggatgactaatggtgttagtgagatatctaatctttaatatttcgcttctgcatcatatttctccctcattaccacatataattcagatacatctttatttggcaaagagccactggatcttgggtttttgccccattgtgtgtccttagcattgcagactcaaggtttacttttttttcttgcgttgattaaagccttcagtctcctgacttaagcctgtagtgttcaaatacagagatgtatttgtctctgcactgtctaaataaaccaagacttgctctgaaattcaaggtatgatcctagcaatgaaaaggtagcctttctgagagacaaagacattgtcgttctactacctgcagagcaaattgattagattgttctcaagtcaacaaggtggctaaatattaacctaattcaccataaagtctaaagttaaagttgttagtagatgttatataacacgagggaactctgtagattcttaatacctactcaggacctttcatatgtcttgttgggcagtaagaccttatgaagccaaaatttgagttttctctttttcctttaaattcctccagtgattgtgcaagattattattgttacagtcaaagaagttctagatcagttactgataccactgaattaaagtagctggaaatcatgatcccgttgctttactttgtaattgacttgatgactttggacctagtctagtagctatcaatcttcatagctacgggaaatctttattcaatgttctttcattaggtctttgtgcaagtctccaatgatggtgaaaagatggccaaaatgaagggaatctgaagaggttaggaatgggcattcctatggaatataaacaaaggtgtcagggtgaggaatggcagagtttgtttgagggaaactgcagttgtattaccttttttaagaaggcaaagaatgagaggagatgaggctgaccaggtcagcaagggcaggtcgggaagggtgtggtacccactgcagagttgctgcctccgtgcctagtctagggagcaactcaagggtgtgatccaggagtcaggccatgatattgacatgaatatacgccacacaggcagctgtgcggagggtaactttgaaaagagcgatgctggaacgaggaaatcaagctggggggagtcacatgggagcccaggaaagagatgattagagccttaagtaaggtgatagaaatgaagtagacaggctgatctgagtgatatttcgggggaggatagagctgtttgattcggtagttctgtgggactagggtatgaaggaatgattcccagggctggtaactacaaaacaagatgatagtagttatttgcagctgggactgataattcaggaggagttgcagcaggtccatcctttaatgcagcagtgtttattagaggtccttcctgaagggctgagtagctggaaggtgataaatgaggtatggaagaggtcgagttgaggtcctggtgacatctccatgtgtaaatgtctgacagtctgagagatagaactctgatgcttgtagaaaggatataagcctgagatattaggactgtgagtcgccagctcacaggtggtagttgaaaccgtgagaatgaatttatatatcccgggagcatgtagcagaaggagaacactggatttggtagaactccggaagatgtgaacattaaagtgtgtatttaattacttttatttttagtagagaatacatgtatattattatacaaaatccaaagggttcaaaaagacatatagagaaaagtgaatccttctccaaccttctcccctggctgtggtgtttccagctctggaggctgccatctttcttggtttcttgtgtttccttccaaacatgctctctacatatgcaaatatttgcaaacatatttatggttgttggggttacttcacacagtgtcgtgcagtgttcactctggttttctctttttacttaaaaatctctaattttcacatgctggagaaatgtgccagaagaagaggagggcagagcttgggaatgatgggagcattttcccacaggaggcaggagagagaagggttagggaactaaagtatgggaggaggcgtgaccttgaatgagaggaaggactgcctctgaagacaaagtggtaggtaaggaatttagggtaaggaagggaggaaagaagcataatggaatgaatgttaaaatgtccagtagacatcactggaaataattcaagactgattcctacggctgttcccacatgtttttaaagttggagtggagaggaaagcgtggtatatgatacatttaacgaaactaggcattcaagttacttggtgtattagtccattttcatacggggcaatttacaaagaaaaagaggtttaatggactcacagttccgtgtggctgggaaggcctcacaatcatggcagaaggtgaaggaggaggaaaggcatgtcttacacggtggcaggcaagagagcatgtgcaggagaactgccctttttaaaaccatcagatctcatgagagttactatcacaaaaacagcatgggaaaaccccacccccatgattcagttacctcccactgggttcctcccatgatatgtgcggattatgagagctataattcaagatcagatttgggtggagatccagccaaactatatcatttggtgacatgggccccaaaacaaagggctacagagcccttcttgagacaaagggagctagtttgatcacagaaatcagaaagccaagaccttttatggcaaggatgaataagagctgaagggcatacatgccacatttaagaagctgtgtaagaatggggtcaaccatctcagctctactcaggcagggaggacaggaacatggtagaagtggaatcaccattattcacagactcagtttctaactagcagggccagtgtaactaaatttccttcagtttatccaaagttaattgaagtctgaggggactgattcatagtatgcagttcatggcagtgaatggataacccagaatgaaagtttatttctccctttatcctaattatctctctttttaactgccttgtattaaaatgttatcaaggttgccttaaagcttttttaggaggagacagcatctggtttaagtgcaaatactagatctattaaaatgaggaatatattcattttttcggcacacagcatcctgtgtcttagaatccagtgtcttaggaatcacaataaaaatcaaattgtgttctggtgagcctagaatcttggcatctaaaattggatgtttgtgaggactgcttcatactacaaaaaaattgaagcacccctctggcgattagaatattcacatcttacaagtacagctgccatctccctagaacatgctggataagagtttatgttcttacaatccaatttcccttttttttttttttttttttttagatttttcatgaagaccctcatcctcctgttggccttcatttgccaattgtccctctacagtagaattgattatggtcatgagtttctttagctactttccaggcctgaggatgtaattctgttcaattctgcagatagttactgagtgcttaatgtaattttaaaattatgagactacaaagatgaataagccttggttcttaccctcatggagctcaaaatttattttaaaaaagttaaaatagaaacaactacttatatcctactgttacaagtgctctgggggcacagaggtgaatgatttattctatcagagggagtagagaggcctttacaaagagagtttaagagttgaagactgaatgggagttttccagtctgagagatgggggaaggatgagttttccagactggtggaccagtgagtaatgtgtggcttggaatgaggagaataagagggcagtgggatggtaggtggggactactgtttaaaggactttgtgcatcatactaaggagtttgggttttatcctataagcaggtgaacagtgatggctttttgacgggggggaggattgagaaaaataactgacctggcagaaagctaaagccatgaagattggtagaagcacagtggaatagtccattaaaagatgccaggttcttaactaaggatgtcttaggcaagtgaagaaggggatggagaaattagaaggtcactgaatgaatgagaccaagggaaaatggagagggggaggcatctggtgttacggaaagttttaatttgggaactgggaaatgatcattgaaaaacaaacaaaagcaacctagtgcacccaggaaaaactcctgatttgcaaagggttagtgcatggagagaaagagctacgtatcagacatactgaattctatttgcccaaggacatttcaagtggaaatttcctatgttgattttacgtattcagttttcagaaaggattctttaaaaagtcatagcaatacaattcctgcaatataaataatagatcaatgaacatcatagggattagcatagttgatttgactaagcttcagattcagtttgagcttccctgtagccagggagataataggaaacaaagatttgtctgtctcttaatattgaattaaagaagcacgcagcatcctaaagaaacatcattgttttcctggctctacgtaataataataataacaaaaatagctgtcctttgagtgattgctatggacaggaactgttctgagtacatatgaactcctatttaatccttaaaacaaccctatgaaagagaggctgtttccagaggattacgtggcacagagtattaaggacacttcatatggccagcaagtaataggacctgtattcaaacttgggtggtggtcctgaactcttaagcagcgttacacttgaagtgattattggctagtgtccttatcaacatttttataacaaatcccaagggaaattatatgtggctgtttctcatggcctttgataattgtggaaagcttaacattaaaacaccaaagatagggtgacagttctccaaggataaaggtcactgttgcctaaaatgtattctgcagaataccactgagatactctgagaaaaaaaggattccaaggacagtaaaactttgaaagcactcatactggaaagtcatcattacgttagcatttgcactgaggagtttggaagtgaagaaacctgattagctttgtctaacctcatgttgctcccacttacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatgggaagatatttctccctctttatcttatgacagaaatgcaggtatagctttcatctcaaagtaagattaaggtataagttacaaagatgtgtagctactatatggtcctgtgtaatgctacttgaggaaggctgttcctttcctggcactgaaattttagagcttgcataatcagtatatcaacctcgtgtggcttggtgcttagcaagtttcagcttctagagcccatggctaatggagccatccaggagaatgttggagagataggtctgaagccttagaagagaagtcttgattaaggagtaatgagttgcgggaaggggtcatggttgtggcggagatggaagcctggggagaggacagagacctcctaggaagagagtttgtgtaagaagaagaccaaggacctcctgatgtacttgattgtaattgggcatgagcagcccagttagaaatggtttcctgttggtattacatatgtacatggatggcttctgcagatggctaaactcacccattttatttttttactatcttaatagttaaaatatgaccttttcttgtgtctccaaattctgagttaccttatggtgctagtctgtctgttgtaactacaagtcataagtaaatccatatgattcttttcctgtaatttcctggtaaatcaaggcgataatttcaaagataaaaatctgtatttttagctttagcagtgagcatgattcccagtctttttgccttcgagtaaggtttgtttccatggtggaagtaaacaatatcccacactctagaatgtgagctcttcaagggtaagggacagtgtcctacatatatctttatctccacagcactgggtacataaatgtgtcataaaaatgaatgggtaaatatcctttggagtttttctgttacttgatgggtttttggggttgattttcaggtatctcccttgtttttctcatttcttacattattttctttcccaaaatcccttaatatacctgtttagtttgtgatgtcattttccattagactgaaaccatccaagttgtttaggctaacccagacttaagcattttctgggcttatttttggactctttttaaaactcatcatctgaaaatatttaatgtccacacggataattctgaagacatgtgcataccatttttcttttatgtacatgggttaaaccttgatttttccatagtaggagaaagcattataagattttattgttttcactggggtaatatcttttgtgctataagaaataaaattttgaatctagaacttagttttttataagacctttattgagatataattctcgtaccataggagttacccatttacagtgtattagtcactgattattagttaataggttaaccagtattagtaatcactggttattaattacagagttgtgcaaccatcagcgcacaattttagaacatttttatcaccccccaaaagaaatcccatccccattttcaagtcactcctcgtttctcctgcaactactcttttcagccctagcagtagacaatccctgatctactttctgtctctatggatttgcttattctggactgttaatgtaaatgaaataatacaatataaagtcttttgtgactggcttctttcacatagcgtaatcttttaaaatggtatctatattatagcccgtattagtatttcattctttctttaatgctgagtaacatttcattgtatggatataccacattttttaatctattcattacttgatggacatttgggctatttctacttattgtctgttatggataatgcagctatgaacattcatgtacaagtaccggtaattattttaaagaagttattctgggctgggcatggtggctcacacctgtaaacccaacactttggcaggctgaggtgggaggatcacttgagaccaagaatttgagaccagcctgggcaacatggggagataccgtctctacaatttttttttttaattagccaggcatggtggctcatgcctgtagtcccaactactcaagaggctggggctggaggatcacttgagcccaggaattcaaggttacagtgagctatgattacaccactgcactccagcctgggtgacagagcaaggccctgtctcaaaaaaagaaaaaaaaaaaaaagattctatagtttctgtcattgtaatagaggaggccataggatcatatatggcaagagtatatagcagtgcatgccagggagtgaaaaataggccatcaaattgaagttactgggagaacttaagactaagtctaactacgcatgagggattgaagccgggacacacaaagcttaaaattatgattcttctagagactgttacggctttttgctgaccacagacaatgaaagtttgatattttgctgtatttgtctgaaaatggaaacacacttttcccaatggcagtattcctgaggactagagttcttcacctctaaaacctctccaatcctagtttttccttttggctgatgatgaccagccactgccatttttgtcttaggttttgttagtctgtcttatttccagttataagtggttaaaatttcttatgaattcttcttgtgttgaacttttgattaatacatttagtctatagacagtaatgaattagcatctgatcaggaatttgtgaaaaacatctcagtcattaaagattaagaaactgaagccaattaatattgtcatgttctgtctcttggaacttgagcaagatacagatctacgtgtcaatgacatatccagaaaatagactccacctagatacattaaccctgtacccttggtccacatattttatttcagcaatgatccatggacatattataatttgacagtttcatcacatacctagcgtattgggtcaaatcaaggaaatctcatcctagtgatcttaactcagtgatttcattttgcccagatgttcagctgtgataaactttactaaggcacagatgatggatgatacacaataattccaaaatttgggggtggctacaatgtggctaggggctagaactcaggtatctacaggacaaatactgagtgattagtcactttctaagcgctagatatgcatatgttctgccaagctcagtaggtctaagtagattgcttccatttcagataattaagtgctttctttttataggaagtttttagcacatctgaggttctaaatccaaaaagtaaataatatatagagaaagaagtaataacaataataatagtaaccaacatttattgaacacagtatgggctgggcatggttcaaagaaagtttgacatatagaatgtcgaccatactggcttaataatcctcataactgaattagtgcttaagtcagttgcccagcctcagcaagcagcagaggcaagtaagtcataaatcaagatcttctgaatccaagaccatctctcaagccttgttctaattctctcctcagccatggatggtgaaaggcaccacaaaggcagcgtgtcaaaaagtggcattgttcaacctttcccctgatggggcaaagcttttatttttttcctttacgttctttgacatctgttttaaaatgcagatatcactagaagaaatgacaactttattataaaatcccagtaaaatgtaaatgtcttatataaaacctttatactgagcaaatttcagtaggaaagggcttggaagtaaggctctgaatgttttaaagggggacagtgctaagaaatgattagaaacaagagcctggaggggtcctgccatttttactgttttgcttaaggctgacctaaaatatgcatagtcttacttctcaccctgtgagcttatccttattaatgtctttttccacctagtttaggggtatttttgaatttgtgtttgataaagatgtctaaagctgtactgtaaaattttattgtcacttttttttttaaatggagtctccctctgttacccagcttggagtgcagtggcatgatcatggctcactgcagcctcaacctcccagactcaagcggtcctcccaccccagcctcctcctcctgagtagctgagactacaggcatgtgtcacgacatatggctaatttttttcaatttttttgtaaagatggtgggggtgtctccctatgttgcccaggctggtcttgaactcctgagctcaagtgatcctcccacctcaacctcccaaagtgctgggattacaggtgtgagccattgcactgagctttattgtaatttcaagggctcaatgcaatttccagtttttaaagttcatcttgcttgcagaatttgtctttcatttaaaaaaaaactgctgattggctacatttatagctgctgtaatagttctgtatgatttactacatttgcctgaatttagattggtggatatgatttagctgcttttaatattatatgagggtaaagccagatttctttggatctattccttttagatggcaatctttgtagttgttctactttacaaaataatccctgtgtgtgctcatgctttggtatacagttaaatgtatgatactgttaagaaaacattgatcactggaaagtgaccttcatttctttatttcataaatatcattatacaactatataactacacgtagtagggaagctccatttaaagagtagatgacttacactgaaatcatttgacctttgtaaattagtttaaattacacagagattgttgtaatgttctttatcatacataatagttacgattgctagagaggcactcataaatcattgctaaaagggccagctgctttcatgttttcagcaggttgagttaagggaacaagccttgccaatttgattaatctcttatgtccattagttggttgggaagtttttttgagtgtaaatttgtatgtagacaacagagtttatattctttatgacataaaattaatcagatatatctacatatttgtagaatggggggattcttagctctatagagaataagaaatactggatggaagactttttttaggatgactggctacaggaagaaattgtagtgacagaagccatgtgtattgaatttgaattaatgttccttagggagctaccagagaaatataatttacaagataatcaagaacgtaaatagattctctgtggagtcgttgtctgatcactgacatatattcatctgtattgaaatgacttcatgactacattctaacaattagagaatcattaggggtgagatgtacgtgtataccttcaagaaaagcaaaatatgtattggtaataattgacagctgttaaaacgagtgcattgtgtacttgttaaacattagaggctgggcatgttggctcacacctgtaatcccagcactttgggaggccgaggcaggcggatcacgaggtcaggagatggagaccatcctggctaacacggtgaaaccctgtctctactaaaaatacaaaaaaaaaaagccgggcgtggtggcgggcacctgtagtcccagtgactctggaggctgaggcaggagaatgtgaacccaggaggcagagcttgcagtgagctgagatcgcaccactgcactccagcatgggcgacagagcgagattccgtctcaaaaaataaaaaataaaaaaataaaaaaaaaacattagaataacttaccttggaacagtaactctgagggaaccttgatcatttatgagaatgatctcccctacgttaatactgcatcaaaactaacattatggtatacctcaaaaagtattggcatagatgtttttaaatataagaaaattcaaatgcgtaattgataagggctaaatggctcaatttcccaacccctaacaaaaatatgccctaacacagctctgtgactatgactgcatttattagaaaacatttagtaaaaatcatctctagttcaaaccctccagcatcagttcttcttgataattctcatgaacatttagaaataccttaaaagagaattcagactcaaatcaaaaaaccttatttcatttggttgcaggccaagatacctcttttaaccatttctggcttttagaatccttatcatgacagcttgtcctatctcagagcttcaggaggaaaaactagtccctcaaaatcaagtttgctattgagcttaataagaggtttctgtatgtcatatgtttgtttagaagaaaagcacttgttcgactcatttaatcctggcctgatgaattaaggcttgaattaatactgagggaaccttgactatacatctacaaaatcaatgtgtcctggtaggcttctgattaagataacattagctcttgcttgaaggcatctttctctgctcctaccatttatccagtggtagataatatatggagtgaaaaatgaaaaagacatagctgggctttaaagcaagatgaacatctctgtgaaccagaaatgtgaaagaaaaaaaaaaaagtaagtggggctaaattagtgggctttcagctcgtgctgtagtaacagggattaaaattctccttacaaggtagtggcccaaagccaggattactatttgaaatcagagccccacaaaaacacacctagagagagacacatacacacttacacttaaaagcaacatgaaaagaaacagtttgctgcaagggtctacagcttatatgcagctatggccctaatgcatagagccgagggaagaggcaaagattcgcagttgggaaagagagcatcacagccttgaaaccaggacctgaaccaatctacctactgcctggcaatgaaatgagtgatatctctgtatcactcagtgtaggagctgcaaactaccaacagatgtggctctaaactctaagcccctgggtatggctgggagaagccataaaaccacctgagagagagataatgagtttaaaaagagaggaaaatattaaagtacacacacatgagaataatagaaaacatacacatgcatatgtatgcacatgcaaaacatcccttgcaaaatttgtctccaaatcacgatccaaaatacatgaagaaatgggatagcaccccccacccaagttaaacatcaaaaagtgaattaggctgggaacagtggctcacacctgtaatcctatcactttgggaggccaaggtgggaggactgcttgtgcccaggtgtttgagactagccagggcaatgtagtgaggtgccatctttacaaaaaataatttaaaatatattagccaggagtggtggtacatgcctgtagtcccaactactcaggaggctgagataggaggatcgcttgagcccaggaggatgaggctgcattgagccataattgtgccactgcactccatcctgggcaacagagtgagaccctatctcaaaaaaaaaaaaagatgaattaattctagaagaaagcaaaataatacactagtacaacaaagatttttacttacatttaagatgctcagaccaggtgcagtggctcacgcctgtaatcccagcactctgggaggctgagatgggtggatcacctgaggtcaggagttcaagaacagcctgcccaacatggtgaaaccctgcctctactaaaaatacaaaaattagctgggcatggtggcaggcacctgtaatcccagctactcaggaggctgaggcaggagagtcgcttgaacccaggaggtggtggttgcagtgagcggagatcgtgccactgcaccccagcctccatctcaaaaaaaaaaaaaaagatgcttaaaggcataaataaggggtaccactcgctaaaataacaagaaactaagaaacagagatggatgaaatgtaactaggtctgaaaacaaagatatctttgccaaaaaaactagtcattgaagttactaaactcaatatacaggataaattctagactttgtcctgtcagagaaggcaagggaattagaagatgatgctgagaatgttactgtgtacaacactcacagaaaaagataagaaatataaatgagcaattaggagaaatggagaattgaccacaggctctacaatataccttactagaatttagaggtttgtttaggagtgtatttgagaggtttcagaagaaaatggaggaaatggtagagaagtaatatttgaagctgtcatagctgagaatcttccagaattgaagaaggatgtgagtcttgaaggaaatgtgctcccaagagaaatttcaaacatctgggaaggaaagaaaggcctgcattgagcaattgatattctttacagctcagctttggctgattaaaatgagccttttctgttttcactggaaaccaccaaaacagaaatgtaatgtgttgtatataccaaaccatgcctcttgaacaagggtccttataaataaatcataaaagaagagccctgtggacaactaaacccacaggatcaagataccaaggaagatctctctagaaaaggcagtctcctgtcagcacctttgtgaaaaataggtgggaagacagtaatggcttgttgtaccatcttgaggtccatgtctaaaaactgttttcaaaaggaacaccatggctgccccaatctggtagaaagaaaaatttgaataggattctacataaaaagtgttgccagttagaacattttgttgaagttttcttttaatgaagagggaaaaatagaaagtaattcctatggaatgagaccttgtgaacattggatactgcttcaagttcacagaaacattgaactgattgccagttaagttctcagaaattagatttaattaatgtggacagttacatacatcggtgcacacccagaagacccgtgtgcagaatctgactgaaggtgtacttacttcgatgaatctcttctcatcactgctttgtcaaagcagattgctatgaaataaactatacaaacaactacccttgaaggctgatagcaataggatttcaatcagtacagataggagattctatttctgtagatgaaaaagatcatacattgattttctgtgtgactttaaataaattcctggaaaccttgtaatgttaggtactaggtagaatgaaaaaaatgaagcaaaacaaaacaaagaaaaaaaccagagtagattgggttttctttctgcttccatgtggagatctagccttttgaaactgagcattttggaagacatgccgtcccctgtggaatgttcattccgagtatgggacaacagaaaatatttagcagacctggtgatgagatgatcttgctttctcaaactggacaatgggaaaactcttcttggctactcactacttacatttcatctcttttctcattgatatagatctcccacatttgtggataggaatttctctcacctgatgaaatatcatctgtgaacaacagaaatctgtcatcttattttggtatttatcacaagtagaagaaagatgtcaagagttctaatcagtcactggatatcaaatatcagaaatgtcctcaattggaattgtattctcagtaaatcctaaagcatttgggaccttcacatgtgctaatactgtttatatttatttggaaattaaccaaatataaccaaaagacagtggaataaccatagaaacctttaaatggaataaaatttatggcaatcaacattattaggaagaaaaagtatactacctagaaacagtgcaagaacaacgaggatcttctgtgcatctaactatataggtctagaaatatataaagtgaattatgatagaattaaaaggagaaactaacaaatccataattatatctcaacactcatctaacaaaaattgatagctacaaataatcaaaaattaataaagatatggacaattttaacaacaaaatcagcacactatgtatttagagactccatctttccaatggaaaaatacacattatttcaagtactcaatgaacatttttagaaagtgactgtgaactaggtcacaaaaagaagtattgctaaatttcaaaggatcagtatcatacaggggttctctgattgaaacgcaattaaattagaaatgcactaagaagtgaaaatggaaatataaccactgtgctcctaaatgactatgggttaagttaaaagaaatcacagtaagaattacaaaacataaggcactgaattgaatcaggtgatgtatataaaaacttttggtatataattaaagtggtaccaaggaggaaatgtataaccctaaatgtgttcattaaaaataaaaaatcaatgacttattcaacctgtaaagcaagaggaaaaaaaagagtaacaagtaaaacattattaatggacataaaatgagaccatagtaagtaaggagcttcactgcattcttggatgtgaagactcaattattatgaacttagttcttcccagtttaacctatgaattcaatgtaattcaaactcaaaatttcaacaagcattttcataaaatcagaaaaccaaacactaaaatcatggagaagatcaaaggggtcagaatagtcaagacaattttgaggaaaaacaaagtgggctgagaaggcctatcagacatcaattgatttaaagctggagtgtgggatctaccagggatatgcagatagaaccacagactagaatacagagctcagaagcacacctgtatatttatggacacttgatgttttgcggaagcatcgttagagatcagtgggaaatagatggaccatacaatgaatgaggctggcttcatagtttatccatgggggaaaagtaaaattagatcgcatgttcacggcaagcacaaaaatagattctgggtaaattcaagtcctaaatgtgaaaaaccaaattttaaactttaaaatgtaggtgtaagaaaagattttcgtgaacaaaacataaaaagcagagaacatacagggatatgttaaaatttacatcttttataccataggatgccataagcaaagttaaagataagctacactaagataagggtagaagatcatatttgccatgcacataactaacaatggattagcatctagaacatatccaaaggtttaaaaagaaaaagacaatccagcaggaaaatgggtaaaggaagcatgaaaagccagttaacatggaagaagtctaaccttgccagtaatccgggatgtatgtgcaaattaaaatgcacccatcaggttaactaaaacttgaatgtctgataacaccaagtatttggtgaggaggtgggccaaatggaaaacctcattcactactgaagcgagagtaaattggtaaaagcaccgatttgtcacccagagcgattcggtgacatgtagcaatgttgaagatgttgctaagatccaacaattccacatcaaactatattctgtaaagaatctcttcaacaggtatccaaggagataggtataaaaaagaatttcattgtatcattgtttataatagtgaaaagttggaaacaacctaaatgtccatggacaggaaaatgttggcatattcaagcaacagaataataataccttatggcagttaaaatagcaaactattatgtatcgacctggagaaatctccaaaatggtgttgaaggcaaaaagcaactcttagaatggtatgtatattcttaaatgtgaagttcttaaatttaaagtttaaaaacatgcaaaataatgttattagattgaatcacataaaatgggtgtttttgtaggtgaaagaaaaatacaggcaaacatcagcatcttttttaagctcaacctagtatttgttgatacattcatggtaacactgggcatgaaattcagtgtggcattatctccttgagggcagcggggaggagagaatggtatggtgttgaggcgggcatgtgagggagcttctgctttggctgttaacttttctttcttcaaaaaacttttgaagaaaatatggcaaatgataaacttatcaaggggaggtgataggaacatgggtatacttactccattcttatacatttctgttgaaaatatttgctaatgtttagagcaaaccaaagtgttgatagaggtataaaatttttaatctcatgacattataaagaaatatttacaaagtgattaaatcctttgctgcttacttatctgaacataccagtcgcgaggcttttagtgtaacataaaaaattgaaaagcatggctcccttcacacaccaggcaaaagcttcaaattttgttttgttcttttagcactggtaagattgtcatcattaaaaccattcattagtgcctcttttgcttgctgttcttcggtggcagtcagatgcatctatctaccatggtatataaaatttggtgatgatattcaaattactttttttcttctttttctttttctttctttttttttcttttttacttttttgatgccaataggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaagtgaggagagagatgggatttttacaaacattcatttttccctcttaaacaaaactaaacctcagagagcactttttataggtgcaacaagcatcaattcttaagtgcttggtatgtgcctgcaaagtgatagtatcaaaggatagaagtagaggagatagaaaaactagtgtgtcttttttgtatttgtccaatattgtttcctaccaaaatggttttttcttgaccaatttgaaatacatcttggggaaaaaaacgcctaaaggtttccactagttctctaaaagtgaatatttcacttcttgaaatggaactatttcatttacaattagttatattttctggtatacctttgtgttttttttctcctaatccctaacacatagttctttaagcctccatcgaaaacctagcaagatactgcattgtaagaggacctacctggacatagttctggctttctgggaattttaaatttttcaattatgttctctctatcttgttacttaatacttcacaaagatatgaatcttccattacagttttgagatctcacatagtctcatcattcacacatgaccttctaaatcttccagttatttaatgtaatgatgtatagtctcattccagtgtagctctgatttttttctcaaatttataagggagcacaattcagatacaaagacagtttctatggattatatcaacagtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggcgaaaaaagtctaaaaagaaaattctaaaaaggtgtattctggcagctctatctggcccacagaaaacttgtataggtgagaagaccagttaggaggcaattgccaaggccaagattggtgagttctgagggcctgcacttgagagatgtgggaggagaggactgtgagactattctataaaaatagacttgccagggggctgggcgtggaggctcacgcctgtaatcccagcactttgggagggtgaggtgggcggatcacaaggttaggagttgaagaccagcccggccaatatggtgaaaccctgtctctactaaaaatagaaaaattagccaggcatggtggtgggcgcctatagtcccagctactcgggaggatgaggcaggagaatcgcttgagcccaggaggcggaggttgcagtgagccaagatggcaccattgcactccagcctgggcgacagagcaagactgtgtctcaaaaaaaaaaaaaaaaaatagagttcccagggtctggggactgagtgcaaattgtaagaagaggaatgaagggagaggatttggttggaagaagatagtgaaacttctgattgtggacataatgtgtttgagaaattgacaggtcttctaagtcatgtcccaaaagaaattaagatacagatctatacttgaagtaagtgggcaaactggagagatttgagaatgagtttcatagaattgattgctgaagggtgtgagatgagaaatctataaaatctataacacaggtgcttcgatccagtgccttggaaaagacctccatttgggtaatgggatagtaaaggatggataagtagggaggttcaaggaagatgtgacaaaaaggtgaaatgctaaagagagctcaatggaaattaaaataaatcacagtccattgggtcactataaatgcattgggtaattttgagaaaccattttaggccaagagaagggaaggtggaaaacttctgtttcaatgaaatgaaagactaggtaatcttaaaatgaatgaggattaaggaaagtgaagacaattttgaaacattaccaagtaagaaggaagccttaggcaaaagttggatgaatttgttgaggaaatggtccacatgttctgttctcattcttagcaatgttctctgcctaggactaggttctaagaaaggtggagctgatgaggcataaatgatcaaaggtcaaaacaagagtagggcattttacagtggtaatgaatggctaggacaggggttcctagccagctgctcattggtttttcctgctgtgtctggctagacaatagagggttttatgaaggccacaaatacttggtcccccttcctcatttctctttctctgtaaaggcccagtaggagtcagctccatcctctctccttacttttccctgggacctaaactggttatatacttggtcctctcaaatcttacctcacagaatagaaaagacctgtgactccttgattccatacacttacagctctattgcctgatatgatgatgtgttcaggaattcatttcatacttgagctcttccatgagggtagaataaagggaggcaaagtgccttaaccaaaatggataggacagaaaggaaaagtcaggggtgtgggtgagttttatggcgaaaaatttggagatcacagtcgggaaaattcaaaagttggatatcatggaagtaaaatactttcaagcaatttctacatctaacatggtgcctcccagcgagctgctgaagattttacttggagatcactgaggggtagggagtacagttcatggagttgatgagaccaacgttgctgagcttatcagcagaggggtgaggtccagatcctgacgacagtggtagatcaggatggaaaagatgttgaagaagatggacgagggctctgaggagatgaacatttctgaggaaagagacagggtagttgaaataaatgtgatgaagttcaagaacctggagcagtgggaagaggcacatcctcctctggagaagccaaatcttgtaggaaagccaggttttgatttttttgagaaggaaaaggatatgtttgaggttattttcctgaatttactacacctccatgatttaaggcaatctctgtgtcagattatctccctccacctgagatctgaatatagctaataaactgttgggattgtaaatgacaacacactacatgaaaaacaactgtatgcatttgcaaagtctgtaaattctgaaaacaactgagctttagtacctcttatttttttctacttcaggattttcccccttttttaagtaagtaaagcatatgaaactaagttacatattttagtggtcagattcagagccctgggtgcttagaagcattaataattatttaggtcgttgacaatggcgaataggcagcatactcgttaaagcactcaaattaaagtgcacattaggatgtggtcctgatgatctgtggagctaaaaagatcatggtagaactgaataccaggacaaaagtgctatattccaatggctaagctaagagataacttgctggcataaaatggataagctgtgttaaatttgtcctctgaaagaaaagactgaattcaagggtactttttcttgaactgtgtattaatctgttttcacactgctataaagaactacctgagactgggtaatttatgaagaaagaggtttattgactcagttccacaaggctggggaggcctcaggaaacttacaatcatgggggaaggtgaaggggaagcaaggcatgtgctacatagcggcaggagagagaaagcgaggggagaactgccacacttttaaaccatcagatcttatgcgaactcactatcatgagaacagcatgggggaaaccgccgccatgatccagtcacctcccaccggacccctcccgcagcacatggggattacaattcaacatgagatttggatggggacacagaaccaaaccatatcgaactgcataagctaacttcatttaaaaaggaaaaaagccttaccgtcttcttgaaggatgcacacaggtgtttaaataaatgcagtgtatatacttgggctttgaaggtttgagatacaaggctgggatctgctgaaccacattctggatagagctgcattctttaaatatgcaaccccgatgactgattttcttttaagtgaaacatgagacaagtcatattaggtgatgtgtctaaagagtcaacatatttcctcaagccatgaaatacttatcactgagtctctatgtaccatttgtattctgtacagttcttactgagacaatgtgctaatgaaacgtacattctattggaggaagcaaatacagaacaaaatagcaattaacaatgtttatcccctattggctctcatgggctccatatacaaatctgtgatgtccagacaactccttatctctgatgactcctaactttccaccagattactgttttttgaagcattttatattttattgatttaaaaattaaactgttcctttgctttttaaaaaatttatcatgtacatttgaggtttatgacataatggctccctagctttttatttagaacaatttcaaacttatggcaaaactgcaattaattcaacagtttgccacatttgctttatagctatttatttatgtacttttacattcatgtgttgttaaatggattgcatatatttagattaacatgtatatctgtatgttaacatatttttatatactgtatatgtttatattttatgtgcatatttaatcatattcatgcgtgtatatagtttgtggatttttttttcactgatccactcaatggttaggtttcatacataacacttcacccctaaacacttgaacacgtgccttctaaaatgaaagatattcttgcataagcacaattatcatgctcaaaaagaacaatactgttatataatgtagaatttaaattcaaatacctccaattctgccaattaatattcttcatagcgatattttacattcaggatcagtgatgtccctgtagtctcctttaatctgaagcactttcccagcctctttaaatctttcatgacattgatatattagaagaggtcgggctagatgttttgtagaatgtcccccaatttgaatttgtctgcttgtatccaagtgattgggttcgggttaaatgttttatgccagattaccatataggtaaggtatcctcagtacatcacatcaaggttttcctcaagattctccatccccttcaccgttcttcactctccctgggcgctccttccatactttggcttctgctatgctgacaactcttaagtcaagatttccagcccagacctcccacctgagcatcttctggataaaattataaataaaaatatagcctaatctgaaatcatgatcaacctttggagcatctcttccaatttcccaatctatacaaagtcattttctaccccttcttcctttacctgccttccttagctatgttccaccaccatcaatccagtcaccaaggtcagtgtgttttgctacttatgaaaaagagcaaaattcttcaattcagctacttctgcccaaatttagccctcatcatgtgttacctgaacagacaatatgaatactttcctaattggttcctctgcctttggtctctctccctttctaagctatcttccagaaacttcagttcctcttctaccattcaaattatatcatattattcccctctttaagcattttatgccttctgtttgacaacagaataaatgtgctctttggccttgagtacattatgttcttaacctgaaatatagcatcctttcttttcactcagtgagttttcttttggaacttaatcatgcattatatcattctggttttgttgttgttgttgttgttgttgttgttgttgtttcttttgtgtgagacggagtctcgctttattgcccaggctggagtgcagtggtgcgatctcagctcattgcaacctccacctcctgggttcaagcgattctcctgcctcaccctcctgagtagctgggattacaggctcgccaccatgcctggctactttttcttgtatttttagtagagacagggtttcaccatgttggccaggctgttcttgaactcccaacctcaagcaatccacccgcctcagcctcccaaagtgctgggattaaaggcatgagccaccacacccagccatgttttcagccagttactagtacttctttcttctgcctacaactccctagaacttaagctccttaaggacaggatgtaagtcttgctcattgtcgttactgtatgaggatactctgtgcaacaaacaatcagtaaagtgcttgttgagttaatattttagaaatcaagcataatacattcttgtgtacacatggaacagcccacacgtttaggaaatttagctactagtttcagtatctttcaccaccattcacaactgatcagctaataatcagcaacaacattgtacaccataatatgttaaaggtgttacacacagaatttatgtgtgaaattgaaagcatcggtcctatatcatatggaaaaaaattaattgtagccaaatgttgggtattggatacatcagtgtgctttttcttctaaaaaatactggagaaaggcaggaaatacacaagtactaagataataacacatcaagtcggaaactggttaaaatccaaagaaaaatgttggtgggcgtatttgttcatacacagccccctttatgagaaaaaataatttcttgtacacagctcctttttaaaaaaaagagaaaataatttgtttagattcagacaaaaacacaggagtaattcttgtgtctattctgcataggctgcgtaggttctggctaaaatcactttttaagcagatagaaccattatcagcgtttgaatcaaagggaagtgagtcagatgggatatcttcccttcaagaaagggatctgaaaccatcgttatatttcagaagactgaagaatatcttgccatggcaaagcattccttttcttttttctcggattaaattgagtcatcccacttcttttttcttcacttcagcagtgattaaaggagactatcatattttgctatatcacggtactatttaactttgactatgtctttccttattttaaaaaatgtttcagtgatttatttggaccacaatcagacaagccaggaagaccaaatagctaataatccaaaaaacattatttttctctttttattatttcagtagttttcagggaacccaggtggtgtttggttacatgaataagttcttcggtggtgatttctgacatttgggtgcatccatcacctgagcagtgtacactgtacccaacgtgtagtcttttatccttcacccccctcccacccttccccccaagtccccagagtccatggtatcattctcatgcctttgcatccgcatagcttagctcccacttataagtgagaaagtacaatgtttggttgtctattcctgagttactttacttagagtaatggtctccaactccatccaggttgctgtgaatgccattatttcattcctttcatgactaatattccatggcgtgtgtgtgtgtgtgtgtgtgtgtgtgtgtgtgtatataaacaccacgtacatactgcattttctttatccactcgttggttgatgggcatttaagctagttccgtatttctgcaattatgaattgcgctgctataatcttggtatgcaagtatatttttcacataatgacttcctttcctttgggtagatatccagtagtgggactgctggatcaaatggtagttctacattttagttctttaaggagcctccatagtgttttccatagtggttgtcctagtttacattcccaccagcagtgtaaaagtgttctgttttcaccacatccacactgacatctattatttatgcatgtttgtggaaatcaccttggagtagagtcaagtttaagtgttaaagcattgccatcaactaagtttaaaatcccccaaagactagcaatatgctatttgagcaggcaatgaatctgtgaagtagggataagggctgtgcaggtctctagtgtgcaactggaactcagtattttcttgttgaataagtgaaaaaagtgaaaaggtgtttttgtttttggtgatgaggggcttgtgatgacaggtattattgttagagtcagaaatattttgaggttgcctattaatatggtttggctctgtgttcccacctaaatctcatctcaaattgtaatccccacgtgtcaggggagggacctgatgggaggtgactggatcatgaagaagttttcccccatgctgttctcgtgatagtgagtgagttctcaggagagctgatggtttttaaagtgtgtggcacttcccccttctctctctctctctctctctctctctctctctctctctctctctctctctctctctctctctcctgctgccatgtaagaggtgccttgcttcccctttgccttccaccatgattctaaacttataatcatgaggcctcctgaggcctcctcacgcatctggaactgtgagtcaattaaacctctttcctttataaattacccagtctcaggtagtatctctatagcagtgtgaaaatggattaatacacctattatgttgtagctacatagtgtatgattagacaagccataaatattatatctggcttgtttcatgcccataatagtgtatcagtcagctgttgctgcataacaaataaccacaaaattctcaagttgcatatttctcattcacgcatctgttgtttggctgaacttttgctggcaatcagctggacttgacaccaagttgtggtttgggttcaggtctgttcaacatgtctctcatccttcttgggctagcaagctacctgggccatatgcttcttgtgcacataaacacaagcgggcaaccccaaccagtcaaagacattctaagcctctacttttgtcatgcccgcttacattccattttccaaagcaggttatgtggccaaatccgaatccccaggccagggaagtactgttttcccagctcttgttcactctgctttatctacattagacttcttgctgtgcttgaggaagccagtcacactctcctctcagagtctttgcatttgccaatccttctgtctggagcacttttccctcaaatacttgtgcaactcataccctccagttcttaaagcttttgctcaactgcatctcatcaatgaggacttccaagactccactttctgatgactctcattgtcccttgctagccctctcctcagagtgttcatcaccactcaagatacctatatagtttacttatttacttgttaagcctgtgtgcctccttatgaatgcgagtttcacagagagagtgtgtgggtggggtttgtttgcttattgctatatcttcagtgaacaatatgccaggcactgttcaaccatttgaacagtgcctggcatatatagttggattttaataaatatttgaataaataaatgaatcttactgtttttaaacttttgtggtttttaaaaggcattttaaaaatctgggttagtatcaaatattacaatggtattactttaacttcaggtttcatttagctgttttaacttttacaatatattctgacacagaaaatattaggcattaagcatttttcaatgagttgattcacttctactcatgcacatatgtgatgtctgatttcgattcttaaaaagagatgagcctgggcgtggtggctcacgcctgtaatcccagcactttgggaggccgaggcaggtggatcacgaggtcaggagattgagactattctggctaacacggtgaaaccctgtctctactaaaaaatataaaaaattagccaggcgtggtggcacgcgcctgtagtcccagctactcaggaggctgaggcaggagaatcacttgaacccggaaggcagaggttgcagctagccgagattccaccactgcactccagcctgggtgacagagcaagactccatctcaaaaaaaaagaaaaagagaaaaaaagcaatgcattaaaaccatcttgagaaatcatgaaaatatggagaaaagaagaaaacaagattatactctacttgtttttatactacctagaatgtaataggcactcaaaaaaatgtctgaatggatacaattatcactgccttaaaagttttccattaaagcaaagaagccaattttacatttgtattatacttggacactcatattaaagactcacagagagtttatctggaaaaataaacttggctgacatcattaggtttatactttataatttgatctttgaaataattcaggaacaggaatgccagtcacttcattgaactgtacctgaattttaacacagtacaattgagttcctagagctccaatatgatgtaattaaactgtcagaaatattaacatcgatgttcatgagcgtcgttcatgatgttctcttggttctgatttattcagtgaggcatactgtcactgaagtggacttactgccattaaaaatgcctcatgtttcccagttccgcaaaaatttgcatcagtaatgaaacagagagatgtaatcagccctgcagttgtcaggatcttgatcctcttggtagtatttcattcatttcatcttcaccagataatggtagtttaaaaccgcaagaaaaatgaaactaaaaatagtgaatttcacttctttttctaaaggcataaacttaagcaaatagtgcatgtgtgtgaggggggaggaagagagagagaaagaggagagagagagtttgtaactattccttttctgctttgtgaccttaattcttcagcacccatttcctgtacttaatattgcaaagaggtttcctgtggtatgttaccaggagactcatgtagtctgaggctttttatctaccttacgttcttatccctccattctaataaaaatatgaagcctcacatccacctagaatatgattttgtcttaatggttagcattggcaatgattcttttagcttctgctgttaaaaaaaaaaaaaggaataaatgcaggattctaatcaaacatgaaaatccaagtggcatagaccaaagggaatgagaagcatatttaagtcatttagtcactggcttccgaagcagttccaagtcagatgtaaacctgaggttgtccctaattaagttcattatggttgacttgctaaagcaaggtcttgttttagatggaagtgacaatgtgcaaaacaaacagagcttgaatagaagttattttcactattggaagattgtatattatgaaaagttagtttcaaaggacctttaaagtttaattttgtttgcacctaagaaatttccctttaacttgcaaatgctgtttgaagtgtatttctttaacacatgaacaaacaatacagacacagattcacaaaatctacaaggagatttccattcccagtgaatatcatccatccataggtttctttgcttccagatcatcattctctcctcacataaacagtcaaaatgtttgtaatgtcttctttataaaacccaaaacataattatgataaagtagtcccaagtaacagaggaaaggaccataactctccaatatatgccatatctacagtttttagaatattcatatttcattacctatataggatatatactatttttatttctattacattggagtttaaaggtacttgagtttcgtttgtatttttggttaaatgtcaaaacaaagagtgaaaaaaagacctcagtgtctcaactcccttcttaccttcatgaagtgactgcaaagtgttcaattcttactcttttgtgttgaggagacagcactgcaagtgtgcagtaatacttattttattacatagaacaaagtttcacatttgtgaatggggcacaaaagagagcttgtcagttttacctttttcaattgactttttcttttattctttttaacttttaaatttattttttgtttttttgtttttttgtttttaaatagagacagggtctcactatgttgcccaagctgctctcaaattcctggcagcaaacaatcctcccacctcggcttcccaaagggctgggattacaggcatgagcgaccgcacccagcctgttttttactgtagtataatatttgtacatatttatggagtgcatttgatattttgttgcatacacagaatgtgttaatgatcaagtcagggtatttagagtattcattatctcatgtatttatcatttctatgtgcggggcacatttcaagtaactagtcaacttttaaaaagatacgcagtaggctgggcgtgttggctcacgcctgtaatcccagcactttgggaggctgaggtgggcagatcatgaggtcaggagttcgagaccagcctggccaatatggtgaaaccctgtctctactaaaaatacaaaaattagctggacgtgttggcgcatgcctgtagtcccagctactcgggaggctgaggcagaagaatcgtttgaacctgggaggcggaggttgcagtgagccaagatcgtgccactgcactccagcctgggtgacagagcaagactccatctcaaaaaaaaaaaaaaaaaaagatatacagtttttttttctccaagggtaatgatatagataaactactgtatggatttcttcttccctttaaagaattacttcctcattattaagcttgagggttttctttgttatttatgagcaagtgaaatgaatttataatggtgttaaaaatgtaatcatggccctttaatatctgttttctataaatgtaattttccattatttgtttttgcttttattaaggtgaggaagatcttctcagtcctccccaggacacaagcacagggttagaggaggtgatggagcaactcaacaactccttccctagttcaagaggtaagctccaatacctagaagggactcagatttgctgggatcaggccactcgcttccctacccaactggtgtgtgtattttccatatggaagccaacacgcagtatcagaatggcaatttgggtccatggtgaaaagatttgatttttaagtgtgaatttgtggtttagagtactctgaattcaaatacccgtgagggcaacatgtttccaaaaataagaataccaccctctatttgtcaagtattttacttgcttcacacattagtctgaagagttaattatgaggtgccctttactgaagagcaattattatgtgacttttacagatgaggaaattaatgccctgatagtgcctttgccagggacatatggctactacgtgctacagcaaggcctagaacaatgcctactgattggtagtggtagagattctgacttgccatctgatgccctttatatttaaaaattgtatcttactccatcatttaaatatagggacaattaaatcttcatagagtagttggttattttttacttcgatagaggaaatacaggcttagcaaagaaagacattaatatttttctttttcttcatcactttggccttgcgtattttacccccatacaaaaacagcattttaccctgcagaattttcccactggcttgcatgagcttcagatgtcttgcttcatccaagatgatgttttgctgctactgttcgtttctgggggcatttatttggtttattgccctcacataaaacaaagtcactctctcgccttccttcaacgaataaaaaggatggtggcagtcacctgtgatcaaatagaagaaaagcctagagaaacaaaagggagaaaacacaaggctttgtggccagtgattggcacctctaatgggtagcctgggagggacgggcagcaggaaatctgggctgtttgttcctctccataagggcaatgaggagggtgtattgagtagtgtgtttttcctatctttttgttcagtgtcagttaacaatggccatttcctagctatttgatgtgcaagtaaacgttgtgcagtgcacattaaaagcaataatgttctggtagagcgttgctaaggaaccgtcaggggaagctaattttaaatgtctgcaccagccatcttttcactgctgagcgccactgaagtgatgattttaacagataaaaatcttatctgtcttccacccacctccacatcccccaccgccacccgcatccccattctgactatcttaggtatctccttcttctagatgtcataattcataatgagaagatcatacacaggcttgacagaatcaggtgctttcacgtgtctcctcattactttgtcctgcttgcttttactagcacctactacgtaccagtggaggtagtagggatggaaagaagaaatgacaaattccttgccttcaaggtacttatggtcaattgcagatacagaactccaaagaaattcaaatcacagtacaatcattgattactgtatgatcctggccccttgaactggcagcttgcttacctgctctggaaagttgctggctgccctgttggcaccctgggcatttcttccacatctaaacaagaggttagtagagaagaagctacagcaaggctcatgactctgcttcttcataggcagccttgacttcctagactcctttttgtacctgagtttctggtccaccctaattagctgtaaggtgaaatcctttgcaccatctccctgtgtcccgcttttagagtccttaaagctagataccacatgggtgtagaagcttcctggaagacaagaaatatacctcctctgatatggtatttagcagtcagtatctctgatgttgatttacttacttgtatggaaacttgggaaactcaattcaggccacctggatagtgtttactaaattagtgcttacggaagaatttcaggccttaagggctgatttaagttctcaaatgtgggagaaggaagccttgtccgataccaattccattaacttaagttccggcttactcagtggtacccttgtggcctgagaaaataaattcacattcttaaaaaacaaaacaattaaatacacaaaaaacacaagagagtagctaaggtattggaaaatctggcctatcattctgtaataccatgatcttggcatttcctcacgttttgctactttcagctaactcaggctttcttacaggcctttttctccccaaattcaagtggataaaaagtttcattattgtaaaaattaggctaattattgatgcactcaaaaaagtggtttttggatgctttctttccaactaaaagcacttttgttttttaattttgaaaaatggcatatgtgtgtgtacacacacatataccgtcaagtttggcgggaacatcttaccagttggtagatgtgttcagctgatattaagcagaaattcttgagaatcttaacatcttgggattacaaagtctttcaaatggaagagccttgaaaggtcattttaacacttttgacatccaggacagtgatttctgactctgttttgatggttatccatatcagaggaacattttacatcacaaactggggtaaagatataaaataaattgtacatgtgtttatgtacacacatgtatatatacacccaccatatgtacacacacacatttacagtgtcatatgcatacaaagatcagaaacaaaagtttcatcaagtgatgccttccatactacatacagtgcatgctgtttttctattttatttatttaaaaacaaaatgctggttgcaacccactaaatggattttctgaaccagtggtttaaaaatactaatctatgtgatctcagtttttcttgcctggttgaattatctttcaaaaaaatttaaattttgagatttttgccgtggaagtttctgccaagacgttgctaatgtctcagagacctttatagttttattctaacactaccatccatgttctcattgttgtgttacaaaaaacaaagttcatgattgctacagctgttttggacagctgtttgagtaactcaaaacagatgtgagagccagaggtctgacatttagtggaaatgtgctattaaataccaccgcgtggtttacttaaccctgctagataattgcccacagaggaaaagccgtttttaaaaaacttatgctcttcataaacataaagtatatagataggtaagctattatgtacctcaaatttacaacttttctgttgccccttgccacagagttggtcctgaaggtgtcagctaacctttctttatcttttattttcacaaagagtacctggaagccaagaaaagtcaagtgccttatttatggccattcagcaggttaagttaggcttctaatcttatcttaatggctttgctaaactgttatcaaaattaataaatgagtggcatgcttctccatttagtgataaaccgatggccaacactatcctgcataataggcaatataagcaggagcatattcaagatatgaatgtgtaaacattcagctttgtgattatatctttctggttggtctctagatatacttagttgttcacaaacacttgggagatttgagtggctcagtgtatatttgaacactgaatattagccaatttctatctaatctgtctatctctaatctcttcctttgtaagtatatgtgtagaaattgaattatagtgtaataagtcattatctactttactataaggtactctctaaagctctgccattctataggaaaactacatgggtacaataaacaaacgtaatttaaaaaataaccccattaagtgatttgtccataagtctctgatcatttagcagactaacaaagatatttttatatgtatgtgcattgatgaaagaaacgctctcctagtcagtagtatggtattaggctctctaaaatgtggtaccactttatatagatgaatgaataataggagccaagataagctcttaatgcagtaaaacaatccagaaagcagttagcagtgctactatttctgctacctgtacaatctcttgcctactgacctgtgccacattatctccaccagcccatgccatcctctttttttcataccatcccctctcaaataagcccgcgtacattctatcaaatacccctaaattaccaacccaacagctttgtaaaacctaccgtcttttaaaattaaaatcttattctgtggttcttttatggaagagcaacataaagaacaaaggcagatagaaatatggtgtgccctttttcaggcaccattctgtttcctgtatgctcccacaaaggatttgagcggttatccctttaatccaggactagcaaactacatacagcccaaatgccaaatctggcccaatacctgtttttataaagctttattggaacacagccatacccattcatttacatgttgcctatagttgctttctcattaccagggcagagtagttgcagcagtgctgaatagctggtccagagaccgtgggcttgcaaagcctgaaatatttactatctggccctttatggggaaaatttgccaatccctgctttacgctattatttcgttgtccattctgactcattacatgtatagagtcacaggcttctgtgctgatcaactttcagctgaacaagattattgagctgaaattgaattgatttatagatttatattcatattcaccaaagagcctgcaagtgtggccatttgaatttttttgacttataaaataacagaaatcctaaaaagggacttattcttccttaagtattttaaatagtcagtgaattaatataaaagaggctaaaagcacccagaaacagtactgtcctgcaattccaactctaaaataatgaattacaatcaataatgtcaattttatagtgcccgaggaaattagacttctcgggacctgaccaagccctttatttagactcaggactgccccagcacacttcccttttgtcttgattcatttcctgacaacacatcacattgccagatggacactgtaactgaaggtctacagaaactcatttccaaaaaaaaataaatgtttagaaaatgaaacatatctgaaactttatttatcggtcaagaacttttaaaaatgttgtaatcaagtagcctctgttttgtcagcgtagaactagtccttttacagtagaaaatatcatttgtttttaactttttctaaagtgaaaaaaaggaccttccttttgtaatgtgttaatgagtacgtggggacccaagtgatgagggaggattttagaagagattagagttagcttggctctgggaggtccattttcataaaatatggtttctgaagaaggatctggaacataacacaagtcatttgctgctacatattaagaaataatcaattgataactgagttctgaatatggcttagtgtagaattactaaagatatgtatcattaagcattcaaagaatcatcgttacattctgaagtacataaccataattacattctaaatcacatggctttctaacaacactgtccttcctaaagatctcaagttttcaaaactagaccaaagttacatgccgaaacaagttacccacctttggcatccaaactaaagtgtgccagtgaagggcaagttacttataacacagaaggactcctcttggtcatgacccaactactactttaccaattcacttcagccagtatttatcaaataccaaaagtgtgtatatacggtacagggcattgggcatagagaggtggatgagcaacatgtggaccccgtcctcaagaggcttatagtcttacaggggaagggaattaattctgccaccagacagtattatgaaacataaagatacttttttaaaaaaaccttgctaaaggaatcaaaaagaaggggtgagtgattcatactgggatttcagccatcaaggaaagaatgatgttctcctccccaaatgatgggaacatcatttggtatggatctcccactagtgacacccacagctgaggagctagtacccatttttctccctcttttccctggcttgaggagcatcttaaatacctggcccttacgtggtcaagctgaaaatctgatactcctaagaaatcgctgagtcatgtaggaaattcagaaggaagagaggaagggagagaaggagaaagggagggaagaaagagaaggagagagggaagaaaaacttagaaactatccttaaatgtatactagaagttttgaaccctaaccttgagtgagttttgaaaggtttctattggtgtcgtagctccatacctcttcattccagactagtagttctcaaattgtttcagggagtttttagtcttcttggagccactgagaatgatgggtggaggggaaagggagatgctgtacaggatctctcacagctctgctttgaactgctcaaaatattggaattccatataagattgttttaggagatgtcccattgctatagttaaaacagtttgaaaaccaagattttaaaggaaattgcatgcccaagacaggctattgacatgtatggacagaagtccctacttttctgtccaattatgacttatcatagaacactttctcatcagagtctacttttgaaatacaaataaatgcatacagatgtaggaatctatgaatcaaggccagtgggtctttagccattgcctcgtaaggctcctgatatttgctgaattggggaggaagtggaaagctcattcctggatctggctctgtggcttgcccattactgggacttacctcttcccctcatctgttctttctgttttctcaaatgcctccaatttcatcatggaaatgctcagcttctatcagatagaacaaattctcccaagaggatggagtccagcctctatgtcgggttctaccttgcatttgatgtgcagactttgggcacacagagtcaactactgtttatgtttcaatgtgctgattgtcaagagtgaagagattctgagactttttttaacattaagtttgagttgtccttgaaaacaatgcccaatttgtcagatttctattctgtgccagttttcatccagtttaatgcgtgaactctatggattttacaaatgacgtcttctggatcatgttatctgtttacactgatcttaagtgtatgtaaaggttatttgactagatgtgtcttttgggttttttgtttctgtttttttttttttttttttttccagcagagaataaatggtcatctcaacatttgtttggtaaaagaagcaaattggtatgaaattgtatatttatgcatgttttttttccctttctgatatctctgcctcttcctctctctattattaaaggaagaaatacccctggaaagccaatgagagaggttagtgagattcaggctcacggccatggcttctgtctgtctcatcctgctttttatgtttggcgtttgtgtaagaattgtgtgtgtgcacgcgcatgtgtgtattacacattgtgtcatcatgtaaggatggtagtcacctctccacttgcagctcatgaggaacattcctcaaatgttcattgccgttgtcatcaccatgacgacaagactggggttgggagcaagaatctctttaaaatggcaatcctttgtagtccctaggttggaatcctgccgttcatcatctgttgccatttgcaacactaacaaaatcttcaaaataaatttagccttgaacataactgatgagtcataaagctttcttccacttccaggaccttagcattttctgccagcgcccttagtttttattcttctgggatgacttcattttgcttttgtttccttttttcttggttcctacgctctttctctcccattttagcgaacattttttgagcacttactgtgtgccaagcattgttctcagcacttgccatctttttcatcatgtcatcttcatgacaaacctgtgaggtaggtactcttattaaccccgttttacagataaggagactgagtcaatgagagagtaagcagtgtgtcccaggtgacagagccaaggatttggatccaggcagtctggctccagacccacactcttaactctcatttgaaaggcttacatcatctcaacgtacccttcagaagatgatcttttttatttggtatttgaagccacacagaacaataaccaattcgattaaaaaattaaatattggagttttgagaggtttttaaaatgcctatttatgggttgaaagggatagggtgcagtcttatcactgaatgtggtttcaggttttacggtgaaagatgcttcttactcctattccaccaggaatattgtctgaatatcgaattacctaattaagtgactgttggatgacaaagtgttaactgacagcccaagtaaaatcaaggttgtctttaccaagaatttaatctgaaggaggagagaaggaaagctctcccatgggatgacagtgttctgggagacaggctggatgggtggagagtccttcttaaatgagaagattctggattccttagcaacaggatggactggagagaccactgattcatttaaacacaggagtcgtaatgaaaactctgccaacatcatgccatacaagtctaatcaatttaatgattcttcagtgtgtctgtgccagtgcctccttccaaggctttgggcagtggggccagggagggaatggtaggctgggaggagaaattgaggaaacctgacttggtgaagcattgaatgcccctgacggtttgcctggttcatgtacttcgtatgtgagacttcttgggttcattcttatggtaagtgccccttaaaatttattcattttaactttttgtagaaaaatgcaccataattttgaccaccttaaacatgtttcactcacaaatgaatttcagaaaaggctagcacatgtaattgaagttatataggcatttgcagacttgactacctgaggtgtatggtgttcagacaagtttccagaagccaaagaatcaaaacaataatgaccttttttaatgctatgaaaatatcccaaatgtacgtaaagcagatttttttcagagattaaattatagagaagaaaagataagcaaatttccctgtagtattccggctttcctttggacaactgaatgctaacaatttatttgggaattgtatttttaaaaaatagagcaccagattgctattgaggtcttggatctttgccagaaagtctcaattccaatcgctgtggaaaacaattccctcaggcagtggtgacgtgtgagactaaatgtgttgcagttagcgccaacttgaaaaacatacaactgccctaatgttcaaggcatagtgcctttgtgttcaataatccttaagaatggattaaatcaatactttctatagacatagttttctgtcaccttgtgcctgaaggtgattgcaaatgcctgaatcctggctgcttttcagtacctctcatacttcatagtatgagattgtaattttgactttagaaaaatctgtcaggtaacattaatgacctcccgaatgctctgccttacacacatggataatagaactaggatacaaatctactttctatagtcatgtcacagtgcagtcttacccctccaacggattaaagtatgattctttagggcagtagtttgtaaaaagagattgacttcttttttctggatctaatgaaaaactccatggaaagaaattagaattatttattctggtaaagcaggtatttagtgaagtaaccaaaggcataatatagatgatgaggtgactctaaaagttctttatttttatagcacaaagatggccacaaggtcatttgtgaaaatgcagcagtgtaaaccggttaaaggccacccaactttttgtcggagtgtgcatggcacattaagaataatgaacctgttttccctggcaaatctttaaatagcagatacccctagaacttatgcttcttgagagactcaagaattttccttccagttagtaactgaacaccatttcaaggaagagaagcaccacttggctatataatccataaatgcatttatttgttttattatattttgaactgccatctacatcccctagcacacagcctaaaaagaaagacactttgtgattatcgataagctgacaggaaaaaaaatgagttttctccccttttcgttgatgttttgtaatatgttttctagctactaggtggactacatactatagtcacatgtgggccatgagaaatacttcgaattacattcaggcaccatgttgtaaaggtcctggactttgtttttactgattttgttaaccgtaaagatcgctagtaattaaaaattggcagttagtccatctatcttcaatttatgcatgaataattatgcagatttcccagggttgctggacagccaaaaatagatacaggggaagccctccaacttgatagcagcagttatatatttgtactctgagctctaaggagcagcaaaggccccactgtgtcgtcttcctgtggtttttatggcacagaaagccaaaaatgatttcagttcttcactgagggctgccaaactattggcccactttatgaatagttgcatatgctttgttaaaaaatttttatacttgcagtctcagccaaaatccaaagtgattttctaaaatataattaatactccatgaaattctttgcactaataaagcacaaaaagatagatatacaaacttggtcaccttaatagaaatgcctgaatgacattaaacttttaataagtaagtcttcagttgatctggtgccatcactgtttaagtgcctgcccgtgaatccgcttcattttgtagagaagctatatctcttgaaataaatattaaaacaaaatactctccctagtctatagctttaatttttattgggatatctttaatttttattggtatttttaacaattattatgggaatctgtaaagttgatacatggcaaggtagtaatagcctagtaaagcatttcagttccaaagacaatacttgaatagtggaaggatttaccaatgtgcaataattaaaattagccatgtaaaactatgggacatagacgaaaaggcaagccataaagtaagtctcagattatcttactctaaatctgaattttgctacgaagtacccagggacattgtgctgttctttttctccgtgctgggagattcgtgctaggtcgtgctgcattattagtaaaaggctattgtgatagttaaccctcatttaggaggagctctaagatggattcacaaaatacccaaatgcatacaatacatgtgggtcaccttataattagggtctagagtaatttggaatgtaaagcaatttttattctgaggtttcctaattcaaatgttaatagtgcaccaaaaggtcaattcaagagtttattattattatttttcaacccaagtaaaagcagagagaaaatagccacctccaccatagcctcagaagcaagccaacagcctgaaacagctttgaaatgaaaagttggtgtggcggtgatggtggcagtgataatggtgacgatggttgggtgctggtgatggtagtggtagttgtgaaggtggtgatggtggtttgattgatagtaaaaaaaatgttcgttaatacaagtagagagtaagtaatcaatcaatcactcatagccaaggtggaaaagatgtatcccatcatggaatattcctgttctgatagaaatcttgtgcttatctatggaattcttttgatatatatttacattgggaacctgaatgtagcttgacatttttccatgtaaacaccagtagcctgatccaacattaagctgatactaacaaacaacgtgtaatggcttcattaataaggctttgcttcttcctggaaactggtgaaaaatcaaaccttgttgtgtacaccctcgatgcagcttctgtgttgtcttcacccagaaatggggaatgatttcccaaatggcaaagaaacagagtgatgctatctatctgcaccttttgtaaagtctgtctttctttctctttgttttccaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcat

SEQ ID NO: 4457 - DNA, 1297366 bp, human
atgagtgccaggaagctgcgaaatctgtcttacaaaaaggtgattgtggaagagtctagaatcttcatttattgttcagcaggattacagaaaagctatcaagagtaaacatttaactgatacactcttattccttctttttaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccaggcaagtacatctgggaatcagcttccattcttttgtttttattacttcaacaaaatgttgcagtgtttctaactttaaatttattcaactagttttccatggggttgttttgattcactgatttgactatttggaggtaggtaggaagaaaagggggtctagatcattagtctaagatttatttttttaaggatgtaatggaggaatttgaaataaagacatttcaaagacaggagcaatacgttctggtgtttctgacttcaaactatactaaaagctagagtaaaaccataggatagtaaatggtaaagaaaatgttttttggccgggtgtggtggctcacacctgtaatcccagccctttgggatgctgaggcccacgaatcacaatgtcaggagttcaagaccagcctggccaacatggtgaaaccctgtctctactaaaaatacaaaaattagccaggtttgttggcacgcgcctgtaatcccagctactcgggaggctgaggcaggagaatcacttgaacacgggaggcggaggttgcagtgagccgagattgcaccactgtactccagcctggaacagagcgagactctatcttataaaaagaaaaaaagaaaatattttctatggcattgttggaaagcagtctcaaacattttattataaactcctcgtttagtcacatggtctatattgttttataaaaatgtgttagttacaagcagtgagtaacacaaaattatcgatataaatttacacctcaattattaatgatcatgctcaatatagctacatgcactcactcccatgcttcattcaaacgaaaatataaaacgtgtttacctgtttttctagaatgagaattaaaatagtgttgaaaataaatctgagttgacttttaaatgagtaaattttaggccataactaaatttacattcactgtaagaagtatttttaaaatgctgttctcattttttaattaacatttaaacatatgtgaagttatcataggtattatttattcaaaagtctttagggttgtgtgatcgcaattactagatctgcttttcaaatcttatatacatgttgtgaacccaatcaccaagtccatgctatgatgagaggagcactagaaggttagctgcaaatctcaaagccttctccctgccagttggtgaagatgtctgaagtttttcactttaaaatgaatttgggggtgatatattagatttgtagatcatggttacaatgcaattacagttaatgaatcaccgttaataggtgttctgggcaacagtatacacaatagcatgagttaatttaccatattgtctaactttgaccaagaatgtccctgataatatgtggcagagtataggtagttttgataggcttaaaaagtccagggaatattatttccttatggagtgcatacaattgcaatagtggatgaagaaagagaattttggggagaatcctgatgataaaatcctcatcatagttttccactgggcaacaagagtaaatattgtagtagaagtgagggataatagtaaacatacttgaggattcaatttttaatttgtcttgatatataatgattgtacatattttagagggtaagtgtgataggtttatacaaacctactccagtatatatatttttcaaacttacacaagccaggttctctagaattaactattcctaagtccgtcccagtttgagtcataatgaaaaaggttttttgatataaaatatttatacatatttatggatacaacatttatgtaatattttcttacatgtatagaaagtgtaatgatcaagtcagggtatttagtgtgtctaccacggcagggtttagtaaaatgcatgataggaatgagtaattgtttctgaattgagaagaactacatgactataaatgaaatacagagtagaactgctttcatttaaactaatgacatgagttttgaaggaatgtttgattaaaaatgcttgtgacgttctgaatggaattaaggaaaaatttgagcagtatgaatactagacattaatattgcaagtttgtacttcaaaatgcataaagaattactttgtgacagacttgcggaatgaaattatgagtagcaaatttgataggcaaagctattatactattgtctttcaaggaaaattggagcttttagggcgaagcatctttagttgaacaggttgtgataaggggcactgtgtgttttttcttatttagaaatggattcaggattttataaacattacttgtttttaatagcaaaatattttgcttggtttttctaaaaaaatactacaataaaaatgttattaactacatcagtagaaaagtactagtaaacagcagaacacagataaattatgaaatttcagatctacttcaagaaagagattttgggcattcagatcaaatctattttccatgcatttcaggtcacacctgcattatcaacatagttcttgacattgagtctccccaatggtaatacataatattggagaatacaagccatctgaaagctcttaaaacattcttctgctccagggttttattttaatatggcagtaagtgaattgttttctagaacagagttctcaggtactcagatttgcttcaaggattatatttcctgaaaagcagctcgaaattcccatgaaataaaatagagagtcaaaagttagatagtgaaataacataagcacagtgtgtaagatgaaggatccactaagaatgccaccaaaatgacattttaaatatagagatggggtggatagatggatggatgtatggattgatggatggatagatagatagatagatagatagatagatagatagatagatagatgaaagaaagaaaagaaaggaatagaatagggactaacttcaatgcattgtattaacaaaaatgtgtttctataaatttgcacttaaagataaaaaggttattgctaattaaaatattagtgcactataatttcttttctcataaatggtatatttagcttaattcatcacggagaagcaggaaaaaatgtatgaagttaccatattaagtcctctttgaaatacctgctcagattttctgtcatatactggtcacgcagatttgtgggtgtctgactccaccgtgtggtgcactgagagttttgctagttaatttgaatcttttagagcattattttttctgcattttaagatcgtttgagatcctcagatataaaagctatggcactaaggaaatgcatactgtatgtacaactttctgacaaccatactcttgttatatataaaagtagatgtagatcaggatgcttctttacattcacattggcatttattactataggaaagaaaagagctgctcacttccttagtgtgttaattgatcagttatttctctgggccctcagattctgaattggatttaaaattatgttacttattttagtgacatgagcttacctacagaagcaaagcttacacttttagaaaataaagctgcatgctgccaggatgtaacagcatgtgttgacctaggagtattttatttcaaaagataacacttagccaattcacagtctttttttttaatactttaagttttagggtacatgtgcacaacgtgcaggttagttgcatatgtatacatgtgccatgttggtgtgctacacccattaactcgtcatttaacattaggtatatctcctaatgctatccctcccccctccccccaccccacaacattccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccaaggtgtatatgtgccacattttctaaatccattgtatcattgtgagacatttgggttggttccaagtctttgctattgagaatagtgccgcaataaacatacgtgtgcatgtgtctttatagcagcatgatttataatcctttgggtatatacccagtaacgggatggctgggtcaaatggtatttctagttctagatccctgaggaatcgccacagtgacttccacaatggttgaactagtttacagtcccaccaacagtgtaaaagtgttcctatttctccacatcctctccagcacctgttgtttcctgactttttaatgatcgccattctaactggtgtgagatggtatctcgttgttttgatttgcatttctctgatggccagtgatgatgagcatttttttatgtgtcttttggctgcataaatgtcttcttttgagaagtgtctgttcatatccttcacccacttgttgatggggttgtttgcttttttcttgtacatttgtttgagttcattgtagattctggatattagccctttgtcagaggagtaggttgcgaaaatcttctcccattctgtaggttgcctgttcactctgatggtagtttcttttgctgtgcagaagctctttagtttaattagatcccatttgtcaattttggcttttgttgccattgcttttgttgttttcgtcatgaagtccttgcccgtgcctatgtcctgaatggtaatgcctaggttttcttctagggtttttatggttttaagtctaacatgtaagtctttaatccatcttgagttaatttttgtataaggtgtaaggaagggatccagtttcagctttctacatatggctagccagttttcccagcaccatttattaaatagggaatcgtttccccatttcttgtttttgtgaggtttgtcaaagatcagatagttgtagatatgtggcattatttatgagggctttgttctgttccattgatctatatctctgttttggtaccagtaccatgctgttttggttactgtagccttgtaatatacagaaaaagagaattttagaccaatatccctgatgaacatcgatgcaaaaatcctcaataaaatactggcaaaccgaatccagcagcacatcaaaaagcttatgcaccatgaccaagtgggcttcatccctgggatgcaaggctggttcaatatatgcaaatcaataaacgtaatccagcatataaacagaaccaatcacaaataccacatgattatctcaatagatccagaaaaggcctttgacaatattcaactacccctcatgctaaaaattctcaataaattaggtattgatgggacaaatctcaaaataataagagctatctatgatgaacccacagccaatatcatactgaatgggcaaaaactggaagcattccctttgaaaactggcacaagacaggggtgccctctctcactgctcctattcaacatactgttggaagttctggccagggcaattaggcaggagaaggaaataaagggtattcaatcaggaaaagaggaagtcaaattgttcctgtttgcagatgacatgattgtatatctagaaaaccccattgtctcagcccaaaatctccttaagctgataagcaacttcagcaaagtctcagcatgcaaaatcaatgtgcaaaaatcacaagcattcttatacaccaataacagacaaacagagagccaaatcatgagtgaactcccattcgcaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagtgtcaatatcgtgaaaatggccatactgcccaaggtaatttatagattcaatgccatccccatcaagctaccaatgcctttcttcagagaattggaaaaaactactttaaagttcatatggaaccataaaggagcctgcatcgccaagtcaatcctaagccaaaagaataaagctggagtcatcatgctacctgacttcaaagtatactacaaggctacagtaaccaaaacagcatggtactggtaccacagtcttaaattaaattatatggccacagcatcaatctacccagtgtcagctcatttaatgagagattttattaaagtacaaaattaagaaaagatttattgaaacagaataaagcaaatggggaaaactcttctagatatggaaatatatcttagaaaacagaaactaggattatttccaaagtactatgattaaaaatgtaacaacctatgcgtgttccttggaaataaataaaaaattaaatcacgaaattgtgtgactgcaaagaaacacatggaacaaatttagtcatttactgttcaatttttcagaactatatattgaagcacagagtttagttttggcacctaaaatcctatagcaacagtctaagtaaccatgctgagccccggagcaatcaaatcaaatctttaggtggatttggtcttcagaatttttggaaacttttttattcattctaatgtgtagctaattggagaatggctttggatggttccctactagtaatgactaaattgttccagagtatttttcatacgacattttctatcactcttctataaagattctcttctatgactgtgtcaacgtttcaatgggagggagtcagagtggcaatcaaactactggtgagattctctcctattttgattttttcctctaatggaaaatgggtgatggaagaaaatatagctgagagctatcgcacaaattttaatttagacaaaaagaatgttcaatatagatgtttgaggctgaactctgcttggctttcttcaattcatttttttctaaccccatttgttaacatgtcaattaacttgcatatggctcttaatcattttaggggacagtgacaactatgtttaaatagctacttaaatgtcttgcaatttttaaaattacaaagatactttcacatacatgatttttttccttttctactaattttagttttgaatctttgatatgtaagaacaacccaacatgggcacctgttgaaagtcaccatgtccttatgtgttgatgcacattttgtaggggaaaacatggccctgttgcttaaattactgcaagcaagagcggagttgcttagcagtggctccagtagctttactgttctatttgttttttcccaaagaattctgatctcatttttttgtaacctcgtgtcccacatagtagatttatgagcaggaatagaggaaggaaacaaattaccttcaaagaagagtgcctcataattaaatattgaaaaatactgccgtggtttgctcaccaagctaggacgtcaggtgttccagagtccactacagaccagacttcctccttctctttttccctcccattaacaatgtgagtacaatttagaaaagaggggatttttaaagcaaagaaagctattaatttaaactaattacgttaaatgcactttaagaagaattcgtaattgcaatcttcccgtgtttatcaaagaagctaaatcttataactcacattaaatataatcggtcatctttaaatgttaacattccaagctatcaaaatcaatggcttaaaaataaagatataactgcagattttggtctatcagattgagcttttgatttcattaaggaataaaacagactcttatagtgtaaataggcatatttgattgccaaacgacttggaacagtgtaactttacagtctgctttattgatttatgagttagacagcagaaacctgcaaaggggaatttatgtggtaattggataatttagtcaaagaagaaaaaaatggagaactaacccagagatttgggttcaaatattaaaacctatctagccatagatgtagactttttattttctttttacacagcccagtagatggtaaacctagtgcatttaattttgaatctgttctaacattgaaaggccacccctatgtgttgctatacagaacttattactctccatttaagaataacttgttagtttcatatgtttaatagtgtgggaaacagtcataaacacaagttgtaggaaatgtaaaatactagaaacttgccacacgtcactgactgtacttggacaacctgtacattattatgtcctcactggctatatgataaagatatagatttctttcatattattttgatgtgtacattttaagactgcaattaaactatagtatgcttttgtaaaaatctatctacaaattctacatataaggatgaaattattaaaattaatggcaaaaactgcaattacttttgcaccagtctaataacttcacgctacagccacagtgaacactattgcaacactctgaatattttgaagtgatccaaatttatcctattatttcccaattttgtcttatgcaaatgaatatttacttcaaagatagcacacagaaaatttatcgatctaaaatgcacagccagataacacttagcataacatactatgttttatttttctttcagcgtttatcgtgattgttaaatcttttatttgctttttaaaaattttccccgtctattcccattctctaaccactaaagttcagctgtaagaccgtgggccacccagcagatttctaacaaatagctggcaaatttattgaattccactgaggtttagtcactaagtatgtgtcagacaaatgtgataggcagtgtaaaatttaaaatgtgaataagcctaacgtggtccttgccatcttgccactcattagatagcaccaaagaaagataaaatttagaaattgctggccacttacgtttaccataatagtgaagaaccatttttccaatggaacttaatagtatcataaagacttcttgtcataatgccttatgattgcccaactttgaagctctgaaaacctttccaaaatactttgaatagtataaaatggaactcttcacatgaaaaggaaagactgatggaaaatatatattttagcctctttatgtattacctagtttttaaggattataccatgtgaatatctaatattttgaaagcattcacgttatttggtaattacagcagcctaatgaagtataaaagttgtgtttaaaagggaatatttgaaaacactagatgaatggttgaggcatgggttgagaacaggatgtgaatgaaaatggacacacaggtttaggggttaataaaaaatgtcctaaagttggattgtggtgatatatacatgactctataaatttcctattgttcattgactatatgtttaaaatgaaaattttatggtatgtaaattgtacctcaaagttgtttttaaaaccctattgaatagagaatatatcaattactattatatatttaaaaagataatttaaggttaccatcaactttttcactccattattttgatgcatagcaaagggtgaaatgtgatgaatgttgttaaataacctggaattaacttaaatggtagatatttattgatggcctactgatgtccgcaagatcttacatagtaatatcataatgttcccattgtttacattctattccatttaatgaattttaatgctaaagcatttttactgaagctgatattttaactcagatctgctttctccactttaataattagccctttattaagtgaaaattaacctagaagtacaatctcccaattatttctaggcagcattccaaaatgttccctagagtttgatttactcatttatctattttgaaaagtaaccataattacttgaaaatacgttatttctattttcaatgtttgtaggcacgtagtagatgtataaacgttacatgagatattttgatacaggcatgcaatgcgtagcaatcaaatcagggtaaatggggtgtctatcaccttaagcatctatcctttgtgatataaaaaattcagttgtactcttttagtttattttaaaatgtagactcaaattacttttttattatggtcatcctgttctagcaaatactaggtcttgctcattatttctaatttttgtacccattaaccatccccacttcctccccaacccctgactacccttcccagcctctagtaaggatccttctactctctatctccatagttcaattatcttaatttttagctcccacaaataactgagaacatgggatgtttgtctttctgtgactggcttatttcacttaacgtaataacgtacaattccatccatgttattgcaaatgacaggacgtcattctttttatggctgaatagtactgtattgtgtataggtaccatattttcttttttttattattatactttaagttttagggtacatgtgcacattgtgcaggttagtcacatatgtatacatgtgccatgctggtgcgctgcacccactaactcgtcatctagcattaggtatatctcccaatgctatccctcccccctccccccaccccacaacagtccccggtgtgtgatgttccccttcctgtgtccatgtgctctcattgttcaattcccacctatgagtgagaacatgcagtgtttggttttttgtccttgagatagtttgctgagaatggtggtttccagcttcatccatgtccctacaaaggacatgaactcatccttttttatggctgcatagtattccaaggtgtatatgtgccacattttctaaatccattgtatcattgtgagacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatgatgagcattttttcatgtgttttttggctgcagaggtacaaggaggaactgataccattccttctgaaactattccaatccatagaaaaagagggaatcctccctaactcattttatgaggccagcatcattctgataccaaagccgggcagagacacaaccaaaaaagagaattttagaccattatccttgatgaacattgatgaaaaaatcctcaataaaatacttgcaaaacgaatccagcagcacatcaaaaagcttatccaccatgatcaagtgggcttcatccttgggatgcaaggctggttcaatatatgcaaatcaataaatgtaatccagcatctaaacagagccaaagacaaaaaccacatgattatctcaatagatgcagaaaaagcctttgacaaaattcaacaacgcttcatgctaaaaattctcaataaattaggtattgatgggacgtatttcaaaataataagagctatctatgacaaacccacagccaatatcatactgaatgggcaaaaaccggaagcattccctttgaaaactggcacaagacagggatgccctctctcaccactcctattcaacatagtgttggaagttctggccagggcaattaggcaggagaaggaaataaagggtgttcaatcaggaaaagaggaagtcaaattgtccctgtttgcagatgacatgattgtatatctagaaaaccatattttctttatccattcgttttttaatggacatttaggttgcttccaaatcttgacttttgtgaacagtgccgcaataaaacacgggagtacagatatttcttcagtgtactgattttctttcttttgggtatatacacagcagtgggattgctggattgtatggtagctctgtttacagttttttgaggaatctcaaaacttgttttccatagtggttgtactagtttacattcctaccagcagtgtatgagggttcccttttctccatatcctcgccaacatttgttattgcttgttttataaataaaaccatttgagttgaagtgagattatatctcactgtggttttgatttactattctgttatgatcagtgatattgagacccttttcatatacccgtttgtcatttatcttctttcaaaaaaaagtctattcagatattttgcccatttttaatcagattattagttttttcctatagagttgtttgagctctttatatattctagttattgatcccttgtcagatgggtagtttggaaatattttctcccattccatgggttgtctcttcactttgtgggttgtatgctttgttgtgaagaagatttttaacttggtgtgttaccatttgtccatttttgctttggttgcctgtgcttgtgtggtatggttcaagaatttcttgcctagaccaatgttctggaggtttctcccaaagttttcttgtggtagtttcataatttgaggtcttagatttaagtatttaatccattttgatttgatttctgtatacggttcaagatagaggtctggttttattctgcatttggatatccaattttcccagcaccatttattgaaggactcctttccccaaagtgtgttcttggcactttgtcaaaaattaggtccctgtagatgtatggatttatctctgtgttctctattctgttctattgggctgtgtgtttgcgcttaagccagtaccatgctgtttcggttactatagctgtgtagtataatttaaagttaggtaaagtgattcctccagtttcattcttttttgcttaggatatatttggctattctgggtctgctgcagttccatataaattttaagattgttttttctatttctgtgaagaatgtctttgttagaaaatacattattataatgaactcttctattatcgttgtcgttattatgactaagcgtaacatcgtttctcaggtatattacaagtaataattatacacaatgtccaattttttatttttaaacggttctgtggtcaagattacgcagaaaaatttatatgctttacttctctgctggagatttttgacccacttttttgtattttcaaaaataaaagtttaacctaaatttgataagaagccacagacactttttcctccagaaatatgttgatataccacaaaactcatatgtcaaggaacaatgtaggggagacactgaaatagactgtttcctttggcctattgcatatttctgataaaagtcaaaacttctttagctgacaaaatttaatttaaaggtaatatttttctaagtaactctacttgggggggggggtttaaaaaaagagtagtacaaagctgtgtgaatttcttctttttttacttgttgaattattataaagtataacctgaaacttttcaacattttttttctatgaaaataattatatttcttgcattttcctatctttggaaagtacatatcatcccaaatcttttgatatattttgtttctttcgttttctaagtacgtgtgatatgtggccatttccctttcttgaaaatagcaatttcaaaattactggctctttcaaaattactaatctaacagtggtacgttcctccatcaatcagtagtctcaacatgaagtattttaatatcttttactaaaatattttcttattttctctaaatttttcctttctttgacaccacagaaactccaataattatttgatatcattttcttcattctgttaagtactttagcctgctgcagtataattttgctggccattttctgttactatatatatgagaatggtttgatgaggtaaagcaagattttaaaaacagccctgctctctgctcagttaactgtaaagtcctatatttaaaatgtgattaatgtttgaatgattttttggttctataattttgccctttaccatattcaatggaaaaatggttaattcgatttcacttgttttattttcctactttgaatatatagtgctgtgaacatagttactgcatgctcaaatgccttttttataatggaatgttgagataagctcaaatgtcttttttaatataatggaaagatgatataatttgctttatattacttgactttgatgaagaaaatctagtgattctgaaaggtactggattgagaacacctcatagagcatatgtgagtgttcacatcagtatccgtgatttgctatgtcctctcactttgtttccattagagtttactgattttatacgaagccaggctgataatttcacaagaatagttgtatgtggttggcttatttgttttcttcaaatgcttactatccatatccccctagatgtatatattaggtgaaaatataactcaaattatacatccctcacatctttaggacaacttagaaatctagtagacaagtagagagatcattttccttcagattgaatcttctatccccaatgttttcttccacaattttattttctttcatcatattctcataatgtcaaaaaagaaaatgattacattgtctttttttatgagtgatttttacataggagattgttcttcccagaagtttcaataatattctgttatttgtacaagttacttttctatttcacaataagcctgcgctaaagtgctaagcattttttacttatgtggttccagaatacagttctgacgaggttaggtaaagtagctggtaaaagatatcctaagtacaagctaaaagttaattacaatttaaatgtaaattttgtggaattaatgtgtaaagatgctggcaaatatgtgtcatgcatgttttacagcttacccatagtagaatcaattggaaatataaagacattttattttataattttagtaatgaattgaattattattaatgaatatgttaagtatatttgatagcctttttccaaatctacttgtatgatgcactctggcaaaaaaaagcaaaaggataacatctacaaagtgttgtatgattcttggatatacacaatatatattaataaatattctgagaagttctgtggtatagacacatgttcatcttcaatttccaaaatatgtttaaccactgagttctttttaatgcataatctactcaatgcataaagaaaattttatctctaatcatattggaacagtactacaaatatgcgaatttcactagaaatgcctatacattatgataaaagtctcacttttatatgatgttcaatgatgatttttttcaatgttaataattttagtggtggcgacctttctaaaaacacagaagctcatcctcaacagtttttctaactatttaatggaaatatgtatatttcaaattccatggaatgctttgccttgagctccaaattgcccaacattcctctcacaggttacttggtccttcatgtcccctgccaacagataaaagtcgagtgtttggttatatgtaagctgttgttgttcctattatttatgacttatgacaacaatatgactcatttgggaaaatgtggaacttatcaggaaggcctgtgttgcagtgatcacttacgctatctttgctttgctttgtaatgctgagcttctagaatttccaggggcagtctttgaaaaaaaaaattataaatagaaaattaaatgctggtttatagaagggtctcttgcaagtgagaggcactgaaacttaaggttctgtagcttcatactaattcctcatctagatagtaattcttactaactcacattcagtctttcctcccattaaattaagcacacacactctgcatgccccaagcctaatctttgctagcttgtttcctacagcctaaaataagatcctatattcttattctctgaccctccaaaaccctttctcagccatatgctagttaaatcatgtaaatttcctaaaaatcaccagattatacagcagatattaatatttatctttctgatcacagagcatgggtttttctgtttttaaaatttttttaaattatactttaagttctagggtacgtgtgcacaacatgcaggtttgttacgtatgtatccatgtgacatgttggtgtgctgcacccattaacttgtcagttacattaggtatatctcctaatgctatccctcccccctccccccaccccacgacaggccctggtgtgtgatgttagtttttctattacattgcatatatttctgctttgtaatttacttatatatctacagtctgcctcttaaaataaggcttctgtaagtataggggcaacaattttgttctcactgtgtggaattgagtagtagaagctgaacgatttgttgaattaaattgactaaatgctatcaacatacgaataagattaaatttctttttttctcacaaatgtccatttggaggatacttttattttaaaatcataattaaagaggcagtataattgttagagggcagcaagtttgttacttcctagttatgttaccttgggcatgttgatgtttctaccttcatttgtacatgaagatgataaatacttatgttaatatgattaggagatggaattaattatataaagtgttagcacataagttcccacaaatatctgtggtggtgaggatactgatgatgatttcttttctttttttttttttttttgtttttttgttttttgctcttctttgaccactctggtataaaaggttaaaggactatgtgtatacttcattttttcctctactaaccttggaggctaaggggatggaaaaacttttaaatacatgtacacagatatgattacagatgtataatttgggccctctaccctctctgagtgtattcttatttttttaaatcagtttcctttcacagtctccacaattgctattgaacttttatcactttgatttaaattccaccttgattctctcctctcatcctcagcagatacctagggttttgtgcttacgaggaaatgacatgttatatcgctgataacttataactaaatatttgtgcaaataacatggacaggtatttttacatatactgtcacatctgatctttttgaccaaaaccaatgtagttgactactgaagaaatgagaatttctcagataagaaaacttcattgctggcttgctattatcattcttgggctagacatgagaaaatcaaggttcagaacatgttgatgctttgcccaaggtggcaagagagagccctgaaatttaaatcctggttactgttaacatgatttcaccctgatactctgagagcaccatgtaggaagcattcaacttcttgcgtcttcacatcttacttttgttttctgaaaaagagccacctctcctcctgttgatattttccgttggccctgagctttgtgcttcactctggttttcttgctttaaacaggtttttttaaaatcaagtttatcttcttacatttaaaaaaaatcactttatgtgttggcttctttcatgtagccttaaagtatgttcaagtctgattgacctgaattttattatgtgtggagacaaaagtctgcaaaagtaatttaaactatttttattagagtgctccttgatccttaatcaggccagcccttgaaaatacgatttctgctctcgtcatccacttctctcttctagctgcaatggtcattgacgagctcatgtaccctgattactattgatcccattgaacctatctcaaactgtcactgttgacctctctctctcattcttaaaattctcacatcaattgatgtgagattttctctcttttctagttcttcttttctttctctttgactgttctttctctttatttggtgcttttctttccatgtcagttaaatttgtgttctccatggttctctctttgttctctctttctgctttcctctaacgcttgaaaacactgaaaaaatacatattatacaaatgtaccctgtttccctctttctctctgtacagacacacatagtgattattaaaatgcaaactcacttcaacatactgctgatttacagtcgcatttcctccctatgaatttccttagttatcggatcaaatattagcaataaaactactgttatctgtgattatgatcaatttcaaattttgaaatttatcttcgtgatcaaaatagtggtaaccattcatttgggacataaagttatttaatacctgatttctacctacatttcttgttaaattttgccaaactccttatgctcttcagtgccctgtctccacaccttgtctctcttcaaccagaaatgcttttgtttttacaactcctatatccttgcgtatccagtatgcatatacagtatttaggactctcatttagaagtaacaaaattgaagtaactaaagcaaaacaaatgagagagaaaggtttttcatatggaaacaggaatgtgtcatagaatccaagggcagtaataaagttttgactcaagaagggactaatgcctgtgttttggttatttatgatagccatttattattcccactaatggttttgcgtgttgagaaagctcacctggatggttctcttttgtggtttcttatgtgattttagtccattgttgtctgatactatagtaacctgaatgctcaactgggctgaacgtccaagatcactcattcacatgcctagcagttgttggctgaaagccttgttgtgattgttgctgaagcacttatccatggcctttcgatgttacttagctttctcagagcataatatgttggatggattctaaaagggagcaccctaagaatgactgttctaaaaagatagacgtggaagctgccaggccacttaaggacttttgccataactggcacttggactatattctattggtcaaagcagtcaaagagtcaacccagatttaaagagctgaagaaataaacttcacctcttgttgagggagtggtaagaggagcatgtgctgtgggagctattattgcagccctctttcgaaaatgctatctacgggctgggcacggtggctcacacctgtaatcccagcactttgggaagccgaggcaggtggatcacctgaggtcaggcattcgagaccatcctgaccaacatggtaaaaccctgtcgctactaaaaaatataaaaattagctgagcatggtggtgggcacctgtaatcgcagctacttggttggctgaggcaggagaatcgcttgaacctgggaggcggaggttgcagtgagccaagatcgtgctattgcgttccagcctgggtgacagagcgagattccatctcaaaacataaataactaactaaataaataaataaagccataccgcattggaagccatcagtgtttttgttaccacctcactccctatgcatctacttctttcttctctctctgttcatggacctttgctcttcctcaatccactctgcaaactagggacttcgtaagcacaatttgctagtatatgtgacacaattcgaagcactcacagtttgaccagactcttctgtcaattctaattttctgagagagattctgatgattctctcttaacacaagcattgtgtgtattctgatcacccataacatggagttggccagaattacgtggcacagacatggttgttactggcccacctttttgaggaggattaacatttccaagatgaaaggccctagccataacccctctaaagcatctgttactcccagcaatgcttactaattattgaaagttctactttaacatcaactcccttatgacatcctccgtacaagcatcactccaccctgcatacttccatccaattttatagattctgtgatgtttcttgctctataaataacgtcatgcacctagatggatccctactcccagattctaggttcacgaaacatatcaatatttctcacacaaggtagttattcaaccaatgaagatcatcgatatggtaataaaataagatacatttatatgcgtatttgctctcatttgttttaaggcagaattctaactatttaggtaattcataattgatttgcctctataattgttaggattaatattctaaggaataatattgaggtacatctgtgaatttataaccttgcataaggagctccttaaccacttagtccatgttcttggtataattctcattactcagttcagggctatagttcgctctggaaactgctaagcaaaactgatgttatcttctaatgatatgtatcagaatttactccaattggtgtaaattcacttacactaatatacgttatgcaaaatgatctgcatgataatgttatgggcactctggtataatttagtttctgctctaaattataataatctaataatgactgaattttaaattagaatgatttgaccgctagctgattttgtatggatttgacagaaataaataaataaatgtattgtgttcgtgtccacatgctgcagagatccctgcctataactggctcagaaattcatatgttaaatgcagaatatactttactatagaacttgatcgaaaatgtctttattgaatatataaatattgaaatgttttatagttatctaaaattcacaatcagtatctgccggaagccatcaaatatctatcagacaaatagcaatacctgtttggggcatttgacttccatttcttagattcatagcttccctgaaatttaactgaaatatggcacataatgactgagtagactacactaaggccaggcacagtggctcacgcctataatcacagctctgtgggaggctgagacaggagaattgcttaagaccaggagtttgggaccaggctgggtcacatagcaagactctgcctctacaaaataaaataaaataaaataaaaagaaggtaattaaggagtattttccacatgcaattttctcattatatctcatccctgtcacagttggctgaatcttacagattaacatcatgtctttggtccgatttgagtgtgacttcaaagataaaacatatcaattctacatataatatataaattacctattgaaaatgatatctgaaatagttgatattgactcaaaatgattattgcttttttcataataatcccatagggaagaaataaatcgtttcacttggataatttatgaaagtaaaaaatatttatgataattctatttaggtgatccacctgcctcgacctcccaaagtgctaggattacaggtgtgaaccaccactcttggccaatttacggtcattttaaaggaagctacatggtagaggtggttgaggagagtttctgaatttcgtcttcttggaaagttagttgttctttgtagagcatgctgactaataatgctatcctcccaacagaaaatccaatctgatttgacaagtcatgagatcagtttagaagaaatgaagaaacataatcaggggaaggaggctgcccaaagagtcctgtctcagattgatgttgcacaggtatatgttatttcagaaactaaggaacgtgttttcgttgggcattatactccagtctatattggacaacttgattattggcaagattggatttgaggacattatttgaaaactataatttgatgtctaaacaatgagtgttttgctctctacattttaaagataaaataggttaataaattaccttttatttagtataacattaagaaaaaactactgaatcattctcccaaatgtatgttttcctgtgttggatgaatggaaaaatactgctttattttgtttttatttttctgtatatcttcagaaataaaggcagatctatcaataaaaataggaccagttattgtttgaaaggcaaaattaaatcagtgcctttttacactgtccttacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtggtatgtatttctggtggcaaatacgcaggtaccccttgactttcctcattaagaagtaactgctcttttataagagagaattgttttcagataaccataataattatactatgtaattttaagattgagaacaaaaattggcacatgtattgtggcctattctgtgtgtcttttttgagtctataattctgctaagaactgtgcagaatataaaaggatgttgcttgtgtttaatttttatgattctttaaatatattttaaatggaaatctagaaaggaaatatattaatctaaaaatagtaacaacaacagtagttgcaataatcctaacaacttcagaaataatggatgccaggtaaactacgtgacatacagaagtcacctttaattcttaaggctacagattacctgagagaatttaaggacaaacagctggtgaatggcaaagcaagattccaattcaggtactcttattccaaactttaataactttcctttaaacaccagtactggatatacagtgaaatgcctcaagacaacaccgaattaaaaggcatggaaaggtacaaatagcctaaagtataaatctgatttaaactttataatattgaacggtgtcctatgttgctgttattggaaactcaccaactgagatgattcctctgaaaacaaagctgaggtatgattgcatctactcgagtaacataagtattattataactctacatgtactatcggccattagagtgggaagtcacataaaatgaaaacacagaatgttattaaagggaaaacaagtctatttagtacttgatattttaagtattgtttctacatctactccataatatcaatgaaaaacagagtccttcagatacatcgtagtcatatcatgaatggggaaatatttttctttttaacaaatatcttaaaataaatacatatatttatgtgtgaaaaatatgaggtattcttattcgataatatattttcataattcaagctgcattttagtggtataattactttaattattctcacccccaaaaagaaacttggaatagaaatgatagaaagtagttagttgatattagatgagtaaggataggaatatatgggaacatatcccatcttaaattttgccaaaaaaaaaaaaaaggaaagcataaatgacccaagtgccttattcatgactaatatttgcaaagtgagcacttttcgttcttttctagaaacaggtctctaatgttaccttataaaatgtatccaacagtaaatatgagctgaaaacaatctcacctgtgtcaagctgtgactgtgccctgcgtcagtacaaaggaaactgctcaaggcatttgctcaattggtttctggttctggtttaaatgtcaggaccaattgaagcagttctttcataagaatatccttacactgtttagttttttcattgtttacgatgctttgtggtgtataccataatcatagtcttgccttcaagacatgtttgtctatttataaaagtcttactttcatgaacacaaatataaataatatttctcccctttgtttataaatattttacttgcctattgaatgaaacaatgttaatggctaacggtaccttgagggaactttcttcatcaaaataaagcatttatattttttgaagttcagagagtaaataatttagaaaaatctctgattccaaattagcatcgttgatttccaacataataattaatttcagtgtttccagatacacagatatttttatatcttctaagaaaaaagtaaaatgaagtaaataatatcatctgggaaactcagacaaaagtcataattattagtgatgaaggaatgttaacatcatttgtcaaagaggattaatatggaaatatacatgtagcattgatcagataattgtccagcctttacaaaatgcttttttttagacattacttttaaactgaaaagagaaattaaacccaatttttgttctaattccataaaaacaattacctactgtcaggtttattttttggtaatactaaaataagtactgatagttcagatttatgactaaacaaattaaagcagagatacataatgtaaactattatatatacgtgtatacgtatatacacacacgtacatatatttgaatacatggccacatacatacaaagacatatatttctaggaaaactacaaagcaaaattaagacatcaagtggtgttggagtggtgttggtggtataattgtgaacatagctgtcttccaaagttatgacacttgtcttatgatgcttttttatagcaacctatgttttgtgaaaccgtatgtgtgtgctttatatttgtgatgtacatgtgaattgtcaataatatttttatatctggttttcatcagcacttttaagaaaataaagttgtgtaatttaattaacattgaaaaggaccttactttcttatatatgatacaatatatattgaaattatgatgtagaaatttaggtgctttaatgttactaatatgtaagtaccatgagaacaatagtgaatgtgtgtgttttggccaccactgacttcccagtgattcaaatactatctgattgatagtaaccactcaataaatacccgatgtaggagtgaattaattcatccaaatttatggctagaattatataactccaacatttaaaatagaagtcatgtaaaattcagaattgacatttatgttctttgattgaagaactaaatatatatatatcacaaaacacatatatatgattaactctctgtttaataagaatagctgcaaatgacacatatatgcatgtgtgtagacaattagaaatattaaatcaacagaaaatgcaaaagctagatattgaccaccgctgcaaaatgctactctattaaaatttcaaacatggaatagcaattaaggggatctctatttatttctgttcataatattatgaaataatttaactctactgattatcatgttttgttttatgtttaaacttagaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtgtgtgcatgctgagaccacaaacacttctttccactttccttataaattgtaaagcaacgggcaataaattatgtatgattagagtcttagcaattctaaacacctctctctctctatgtatatgtatacgtatatatatacacacatatacgtatatatatatatgtacacatatacacaaagataaacatatacacatatttcgatgtggaattctcattaagaaacaataattaatcagtgaggctctgcttattcagattgaaaaatacgtaacgctcagggaggtttttcctggtccatcagatagctctaaaagggtttcttagttgtaagtgttccttattttcattatatatatctacttgtgatgacttgaagactggtaaatattataaactgtatctatttatatgtaggtctaatgttgttaacatattccacagagaccacattaagtttaaaaattacacagtaattatttccctatatggccaagacttgcaaaatctaccacacttggctaataagatagcatggatagccagttaagacctacgtctctgtaattatttttgtatcattgtcctgatcagagtctcatgaccagctccacttcactgctaattcaagatgcctatatctctccatctcacttcgctcaactcaaatattctgtatagattatgatagtaagtagtctcttcactctgttgattgtttgttttgctgagcagaagctttttaggttgatgcgataacagtcgtctagttttcctcttgttgcctgtgctttgggagtcagatccaaaaaaaatgtttgcccagaacaatgtcaggaagctttttcctgttttcttcaaatcattttataggttcaggttttaagtcttgagtccattttgaactggttttttatatgctgtgagataagtgtccaattgcattttcatgcatttggatatccaatttctcagaaccatttattgaagagaatgtccttttttcattgtgtattctcggccccttggttgatcagttgatcataaatatgtggatttattattgggctctctattctgttcctttggtctatatgtctgtttttatactaccatcctgctcttttaattactagagcattatagaatatttttgaatcaggtaattatgatacctccagcttcgttcttttggcttaagattgctttggctattctgggtcttttgttgttcaaaatgaaatttgggattctttcttctacatctgccaaaaatgtcactggaattttaatagggattgcattaagtctgtaaattgctttgagtggtacagacatcttaacaatattatttattccaatccatgaatatgggatatctttccataaacggatatcttagtatttccaaaaatggacttctaacattttaatttcgttctgactgaaagaactgaatttcttggaggataaaaagttatatttttacaactcaggttctcaactttagtgaatagaacaacatcactgataaaattgtcacctcatcttagacagaaatatgaatgtccatgtttgagaaatagctaaggagaggcatatttcttgcatctcagcctgaaagtagattgaaggttatatcttcaagatattagttgccaattccttaccatagaaagtaaattttataattaagttgaaatctggaagtaatcatttttcttagatagtcttgtttttatattttaaaaaccctctaattaatatttgttatgttttaaacaagtttgttgccatcctatgacaaaagattctcctactttgtttcaaaataagaaacactgatactcaattgatgggaaagcattatgataatcttgaaataaaatacatttcaactgttcatttggtctaccaaggtacctttggaatgagatacctttatatcctctagagaaatttatcattgtttaaagatcaccacagacagaaaaattgtatctgcacttgataccttattccggtgcttatcaatttttatagatgccaattatttcatatttaacatcaattacgaaggactgagtaatctctagtctcaaatgtattagagattgaataatctctaatattaatcctaatgctacagcttcagttctggagatatattgtttttgtaattataaattttaaattaataaaatgaatgtatgttatagttataaattacaaattttcagtttataatttgacctgtgtgactttatactaaaataatgtatggatgagtattttttaaattaagaaaatatatgttttggtaaaggggagtttctcagtttactttttaaaatagaggttttttgtgtgtgggctttttatttgtcataggaatttttacgaaatcattgcaagagtaaatttaacataaaataacagaataaatcaattagaatttaaagcaatgaaagtgacattagacgaataatagtgccctgagttgattattattcagaaatgaatgattctcgtaatgatgtcaaaccctatttattcctgaaaatacatatctgagagcttgtgtttattctaaccatttgccacatagtaatatccttaaagcaaaataaaagtgtatgaagaaatcatatttaactttaatagtatcacagaatacagcaaaaacataggccaaacatttatttttgaagtaaatattgatgtagaaacatttgtgactaagggatcatgtataaataccatcttataaaaatgctgtaagtcctatattctttgcctgagaataaaaatattgtctggattttgactcaaaatattttcaacagcagtagctttgtctaatgaaagcaaaggcaacaaaggaaatgttattacattattctttttatgtaagaaggaacccttctattttaaccatcttcagaatttatatggttgtgtctgccacaattgagtatgcattacctttttggagtaatcagctctggctgccataacacaataaaataaactaggtaaattgatttctgcaagtgtggagtctgggagtgcaagatcaaggtgctgatccatttcattcctgaggagagctttcttcttgtcttacctttttgctgtattcttacatggtgatgagtggggagagaaaatataattaatttattaagagatattaaagctggcaccattgatgtaataatacctataacccctttttatttctctatgctctgatttttatggaaatttacataaatagcaatactaatatcatcccttaaatacattgttaacttcgtgaaacaatgactactaaaacattttactgcaggtggcattgtgttaaacgtatccattcctcgcatacacacacaaagtataaaactcaattttccttaagatggcagtgtctcctgttttttaaaaatgtatttagctggaaataaacaaaatgaaataaataaaaatcaatactgcattagctctgggaagatagaatttctttgaaatattgaatctggaatcatttttctaccaataatgcataggaaaaatatgcatagaaacacaccataaagtatattttccctcaccccccacacacccctacaacacaaaattcttgcagtcaaaagggcagatgcttttacttaggaaaaaaaaaaatagaagggaaaatctgtttaaaaaatgaatttacagcctcagcaactaaatgttttctaaatgtacgcacacctctcctaaagaaaataaggaattttattatttggaattggaattgttatcaaggttccagaatatttatttcgattgtagcattttagatgctttatacatatttttatcttttgtgtttttcttgcttatagatagattcttattttggttgtacacacacatacacatagacacacacacacatatatatgacataaatatatgtatcagtcagtggtgcctattgggcttagggcataatgcacaaataacgcacttgtggtggtggtattgttttaaccaattccattacaattgaaattaatctggagtctacctttcagatttcttagcaacaaaagccaaatcttgtccatgttttatttacctgtaaggtagtaaaataaatgtaaataaagcttttgctctatacattcaggcacagttttttattgaaccatccctaaaggtaaataatgagaataaaggaagggattgaggtggtacaatatgtcatgctctctcaaactgttgtctgcctttaccctcgcaatattcctgtgttctattaataagtatagtaatcccatttgacagatgtgttgagaaaaatgaggtgttctgccaaaaatcatactcaagtcgagagtccactacgtatcgcagagcctaacatacttacattccatcatgctgtttctgcagagccaaatatttatatctattgttcagattcccaggcttcatgacagacaagggttttttttaaaaaaaggtgaaaacacataccaaagaaaagaaaaccaggagcaacttgtaagagtataaactctttatgtaaattctaccagttatattttctaacttgtaattaacgatttgcaagtcttcattcattcctttattcaatacataaagcatatttagtgagacctttctttgttcaaggaactttcaggagtagagaggagtaatctaaagatgtgtgaggcaagaagatttgcctttaagaaattgtaatttatctggcttttgttgatgatttgactgcctttagtagaaagagatgctgggatttttattaaaccaaccaactgaaaatcttaacaaaatataggcacatctgagaaggtggtggagaaatacagatttgttcatttcttatgtgagaatatggataatttgcttttgagggtgttggtatcaaacactgagaacaggagcacaggatcaagtaattagtttttctattaatgggaatgaatattgtcttcacattcatctttttgtccctattggatggcaaaattatgtttaaggaggaagtgacctattcactgtattgtttttgagcagatgtgagacactttaaagatgtaacgaggatacagttgagaattctaggtattacacaaatacttttaccttttgagagaattaatcttctatcttcattttgattccttaccagcatgagctagtctcacttgtatatagaggattgtaaaccttcttgccatattattgacacatgacagtaagttttcagtgagaaatgagttttatcttcagtttgacttatatcattgtatttatcataaactttggctataaattatcttagagaaaaattcgtataggtttcttttctaccatgacgacatacaagaccctatcttttggacaaacgatgtcatctgccctagacagtttttattcactcttaatattcagaatatatgatttttataaaatattattttaaaacgtgtaagaaaatagttattttaaataacagaaatataaaagttccaaataagtggttataacgaaatttgaattaaagagtaaactaaattacatttcattataattcttttcaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggtaaaacctatatcactgaaggttattttgaacatacgtgaaaacacataatatgattttgtaaggaagtattaacatgtagcaataatagcattataaatattaatattgtttcatattccctttcttaaaaattaatctgtgcttttcaggaccatgataaaaccaatggtaagctttagcaggagtctctccaaaagcttccttagagttcagtaaattatgaataagaccttaagaaatacataggtcattagtctgaaaattggtccagagatgagatcctataatgtactggcttgcctaagaccatactgcccagatgaatcccacagccatgaagagggcaaggacacagagattgaagacagttgggctggacaggacttgcaagattagcatattgccaaagtcgcatttcagaaagaatctcaaggtgtctatgcaggggctatcatttccatcaccaaatgacacagcgactcctgtaatcattagccgttaaattcttgccctttctctgatggccaatcatttcatgctgcttagaacttagtcaagagactcatagcttagtatttttttttttactgtttattcattaccagattacctgaaagtgtgttgatataaagaaaatagctgatattgataacatgttttacctcaaaatttgccactgtgttaggccatttacacccacttaatgttttaaagttaccaaattaactagatgtataagacgtttatactttatttttaattcaatgtggctatccagattattcaaagttgggaaattttcaataccttatgtaaaaacttacaatcgtataaatgagacccaaactgaaaactgtctttatgtagattcagagaacaagtagtaatatattttgttacataaaatatttccaaataaatagtagggaattaaattgtttttcttctctttcagaataaatgtaatgttagataagatattgaattatagttattcaggatcatacatgagattactatagcaaggaagatacagtatatacaggttaaaactcacattagccttattttttcttatcattcaaacatattacttgaggtatttttgcattagcctcaccatgaaatcattcaaatgttataaggtaatgacctttgcagaggtttctaggttatccttctcatatagaaggcttgaatagtctggagaattgtctgcttgttgaatctgcctggaaagtatttttcataacgtcaaggagcaaagctactgtgagatctagtaggaaaaaaaaaaagcttagaaaactggcatttattttctttctttatagaataaagataatttatcactctatctagatcttttcaaacactaagctgttaatgacatactctaaaatctcttagttgtcaaataaagtatattcatttgcatctgaattacagaacttttttttttttttaccaatttatttggaaggttctcattatttctttaaaaataacaatcataaaagaatatatgccctgcagatctaagccagtcacatttatgataatcattctaatattttaacataaaattcaaactctcatatatgaaaccccgtgactattgagtacattctcatttctcatggtttcttggtaggtggagagcttaattcaagctataagtttcatctgctgtttcaaaagataaatgtcacatttttaaaaactaaattaaattcatttaaatgcaatacattaaatgtagttgccgatcattccaagtatttggaatgtgactgcagcaaatttgaatatctagagtcaatttcttttttattattttaaaaaatttttagacaatttaatttatatctgctgaatttctcccagttctgttgacccaagaacattatatttattttcgtatgaaagtatttgaacatctagtttcaaatattcaaatacataaaaatgtcaattactcatgaagtgattttttgacctttagtttatccaaacaaagcataatttcaagtacattgactatagttaaatagtatcagttttatcttaaagtatcttaattatatttaatatatattaaattccagaaaaattatttagtgtggcttgaagagatacatatggcacaacttgagaagcctaaataaattggaaaactaggaaaaggaaaattatagtagataaataataaaaaattcttgcatagaaatatatccacaatgtatcatgggtggtggaatggacagggaacattttaaagccacaaattggcgccaagcttcctaaaagacaaaaccaagaagtaaacatatttttgagacccaaagtttccaaattattaaaataataattaaaataattttaactttactagtagtatgttagctttttgctagaacttagtgccagaagaaaataaatgggagggtcataaaggtgataacacgctgattcatattcttataataaacaataagaatgtttatttttttctaccaacatggctccatgaaaaagaaaaatttagtgctaaagggccattcaggaaaagcaattctatgagaggaaaaaatattggagcagaagtctaaagtagtctagcaattgttttcagattttcagattctctattttattaatttttaattttgtatggatacatactgggtgtatatatttatgaattataggagacatttttatacaggcatgcaatacgtaattgtcacatcatgtaaccttctgtgaatatgctttcctgcaactgagcttttaagtagaattagacatcagagatttgaaggttatttattttctctgaatacagaaaaaaattttctgtatctttttcctggaaagaagccagattgtttctaactgagaacacatttctatacttggccctatatctaattggaaagcagggcttcatattcatgtgtatgtcatagtactagaaggcttcaatagctaaaaatttttgctaacatagagttttgggtttgaaccagtcacagagaaattggctattgagccttttcgtgccaagcataattgaagaaagaaaactcaccatcgacaactcaaaatatgttgacttctctaggaacctgtatcaatctctcagtgaatgtatttatttgaaaacacagttgggctattactttagctgtaaaagctattgaaaataaagctcagtagtactctcttacttgatgatggcatttaaaaggtgaagtgagaatgttttatagggggcatgaagtatcaagtactgagtgtgatgaaaattaatatactggttaatgataatactgagtctaaatgtactagtttttcctgtgatatgagaaaactagaattcacttttcaagatcaaaattagcaaagaatttggaagtattgctccaattggagaatcagaagtcaccttaaaaacaatacagattttactaatctatagtaatatatatttcataaagtcttcatgtgacacaaaagttttagggttttggtttttaactagccgtgttatataatcgaggaaatttcctatcctaaattagaaaagtataagcatatttaaagttcaattcagtttttcttacattacgaagctgagaaaaatgaatctaacattaaaatcaaaagcaatctggtctggcttactgtattcatgtcaccaatgcggtttatcaaaaatccctgtcatatcaaatcaagcccttccacaatgatctaacacttaagtttttatgagaaaaaaaaaaaattggattctctatactcatttcacctccttaccgtggctgtgggcaggccccagatgatgcattgtctataatataaactatgttggtgaccaccaaagcagccaggcattcttgctgttccttcatttcttactagattatgttatttaattaatttaatagtatttcatcgcctatttatagggccatagtccatgtgcaagcagttttccagtaccaccaaaattctcaataaggtcccatcacaactatcatttaggcctaccataaaatacacagaattaataaaatgagacaaccatcattgtgtgagcaatacttaagtcagccccatgcaccttcagagaggtactactagcattgagatgaattattccaacttgtagggaaaccaaatagataccgaaagaaagagtttattcttatttatttattttgagatggagtcttgctcttgtcaccgatcctggagtgcaatggcccgatctcggctcactgcaacctcctgggttcaagcagttctcctgccccagcctcccgggtagctgggattacagacacctgccaccataccctgctaattttttgtgttttcggtagagttggagtttcaccatgatggtcaggctggtctcgaactcctgacctcaggtcatccacctgcctcggcctcccaaagtgctgggattacaggtgtgagtcaccacacccggccagaagagtttcttacactggccaaaagatcagttatgttctttataaacttggcataggcttagggggcaattcaccatttgttttctaatgctgtgccctttaaaaaggaaggggaaggttgcctaaaacgatgaaagagatgttataaaaatcaagcttcttgagaaatatagtaaaattggaaacaccttaaatgttgcagtgtgttaccatttacacaaaggataaaatatgtagaaatatacattatttagttatatataatatatagtaaaagcagaaagatgtttgggaattaatataaactgaatacagaacaagagctatctctgtgaggaaagacaaaagaattgggtgggatatgaacaggacacttaaatgatacttgtaatatttcattccttaagatgagttatgcatacagaagtaatgattacatttggtatactttctgtgtgtctaaaatcacatataagaacataagaaaacatacaaaagcaaatgcttgggatttttccttttggaaactccactagccaggttctgtaagataacgcttagtaattaaggaacacccacttcgtgagtattattggtttcaaaagagcatggccactgttcattcggtttgcctaagcattggccaaagattctcctgctgattgagcaacaggacaggaacctagcagattaattccagcgagatgaataaggaacattgtctttccagtttttaaagaggatgtttctgtggctttttttttctttattatctacattgaagcatgatcgacagattcttatcaatgatttccttgtgaaagcagagtcaagggaatgaatagcgcaaaccgagaactgagaattttcatcaaagtggaaccaaaagttagcctgtgtatggtcagtttgtgtggcagcagtgctgttctatccttaagaacacttctattcagagagaatcgttattagagaggacagatctgtaagtcactgggtgaggtaacatcagaactgaaggtcctctgaaaatgatcttatttccctttttgtaaacaagaaaactgtgcaaaaagctccatatccctttctctgtttctcgattactttctttttaaaattactttagattcaggggttacatgtgcaagtttgttacatgggtgtattgtgtaacaattctaaaattcatatggaaccaagaaagggcctgaacagctaaagcaatcctaagccaaaagaacaaagttgagggcattacattgccccacttaaaatatactacaaagctgtagtaacgcaaacagcataatactattacagatatagacacctagatcaatggaacagaatagagaactcagaaataaagctgcacacctacaaccaactgatttttgacaaagttggcaaaaataagcaacagagaagggacaccttattcattaaatattgctaggatagctggctagccatatatagaggaatgaacctggacccctacctttcaccatatacaaaaattaactcaagatggattaaagtcttaaatgtaagccctgaaactactaaaaatcctagaataaaacctaggaaaagttcttctggacactggcttaggcaaagaatttatgaccaagacctcaatgacaaatgcaacaaaaacaaaaattgacaaatgagagttaattaaattaaagcttctgtacagaaaaagaaacaatcaacacagtaaacagataacctcctgaatgggagaaaatatttgcaaactttgcatctgacaaaagaataatatccagaatctataaggaacttaaacttgtcaacaagaaattaaaaaaaaacagattaaaaacaggacaaagaacgtgaatagacactcctcgaaagaagacatacaagcggccaatgagcatattaaaaaatcttcaatatcactaatcatcagagagatgccaattaaaccctaaataagataccatctcacaccagtctgaatggcttttgttaaaaagtcagaaaataacggatgttgattgctttcatagggtgaccatgattacatttgtaatagtcattcactcctaaggatttcaaagtcatgtgggtccaggatcctcaatatgaggattaatgttaccatgggaaccatgaaaagagctgacctaataggggccatatcaattctagccaacttcttgagcttcctaatagagaagaatgcctaagagactctctcaccaagaggaaggcaaattaactagtcagataaatgagagcagagatgggcaaactataattggtaggcctaatccattcagccaccttcttttgtacagcccatgggctgaaaattgtttttatgtaaatggttggaaaaaatcaaaagaagaactagatacttcaggacacataaaaattattaaaaatgcatatgtcagtgtctgtacataagactattgaagtgtatcaatttatatttgtttattttttctggctgcttttgtgctaaaacagcagagttgagtaattgtgacagagactgcatggctcacaaagcctagaacaactactatgtggccattcacagaacatattcaaactcctgaactagaggaaagctaatatagaagcagcaccctgtttgaccatagaattttgccatgtcttcttcttgaatgagtatcagaggtttgacatttctgggatccttttgataggccagtggcgttgtagaattggtctttcctaaatagaatgattcatctaagttttcttcctgctcagaattaaatagtaacatattccaaaccatagatactagaatgcatagcccttccaaaagatactgggtggtgcgtgacacaatttaagatgtttaaagataccatctacttgaagagaattacgaactcaagaatgtcttaggtattctaattcttaatgatcccacagagaaagaatgggagaacttccagaagtagtgaggatgtggtcaggggtgattaactgaagggacagctgcaggtaagaaaactgtcctgtgtccccttaccctgtgaccatgtttccaaattatagttacagaaaaaaagaatatattttaaaagtattccaaattgtttaaaaggtaaagaaaaatttttaaattaaaatgacaggaggaaagccatttgagaatattaacaaatgagataaaagattgatgatgaaaattgacaatttaaattattaatgctaattgcaacttcctacagcgacatagccctttcactgtatttttaaattcacccttcaatcagagtagtattaaagagggtaaaattaatgttaagtttttaaaaatatggatcaatcctagctagctgcatggtccagacaacagcaatgccacgaggcagccatcacagtgatatttatcaccccataaatgttcagatacttttccttttctgttaatggaattttctaggctgaggtgacaaacactgatagctgtagaatagagatgatggaaggaaatggcaaggcaatctacaggagattactagcacctgaagagtttgaatactggaactgcacaagttccttgagctttcatgataacccctactctcttggactgttatgtaggcaatagtaattcattcagcaaaaggacagggaaaatgtgtattttggtctctgatatttcccatgtacataagatattgcctgacacataggacatactcatgaaatatctgtttaaacgtaacttgcaaattaagagttgcaaattataatgacaaagcagttcttgagagaagagaaaaatgctgatttacatttaaaattgtacaagttttataacaaacataaataatcacctgatcaaatgttcccgttttatagatgaacaaatacaagtcctggtacatagcaaaactgtaatactatgcctgatttcaacagttttttccactataccaaattatcataagaagtcttattttctagtaattttaaagtaatctaagcttaaaataacaaaaagctacttattcacaataagcatgaaacaaaccatggctaaatttcaagtgcagaaaatataagtcctcattaaaataataaaatgaaaacccgtgtgtatctatcacctactacagtctgtagtctgtccccactgttgtgattttagatttcaaatattgtttgttagtatcttaatatcactctgattagttgagtgtaagtaaatcaatctgaacatcccattactggccaatattgtttagcatatgaattgatcacgaaaacataaccataggaaagtaaatatgtatgtgattaattagaggtttacttccctgaagatcattatgtttgggaaatacaagctttgacaaagtctaatctatatgattttctgatttaatcactaacattttatttctaattttgttttaagcatcaaagattccaactcagttaaataatttagttccattaaacccctaaatatccatggtgtcatctgaaagttcaaatggtagaataagattttctggaaaaaaaaaatttggtcctatagtatgttcatcctaccgcctgttttattaacagtagtcttagtatgccaagagttgcctgagaggaacacacacaaacacacacgcacacaaatggtattaataaatttaactgaaggtgttaaatgcagaataatctatgtctaaatagccacttgtttaacaaattaccgtgtttttcacgtttattttggaaacaaagttttataatatttaacctcaggaagaacaaacattggttgctcaattatcctttggctttcagttcactcttagaatttaatgactatcactcaataaaaactcagaatgcatctttctgtttgcctgtggttttcaacattggttgcacatcaaaatcacccgagaaacttgaaaagtatcccaatgtttggggcccacttccagagattctgatttaattggtctaactctaactagctctcttattcagcaaagttgagaatcactagataatgtgatacaagatccgcgaatttcaagctgtctgacgagagcctaaattcagctcagtcaaccatgtcttgtatatatattttttataacagtaagatttcacagtttaaagagatctggtttctggtcctagattatctggataactgcctcaactcatcattcctcttagctataaaaatataagaactattacttactctaaagtctgttatactctcattcccctgaaaaattacgtatcttttttttttaaagtgagcagagtaatttatctgtgaagtgaaataacactagcagatcattaacttggtgcaatgaatgcatcaagcagctgttacttagaaaatagaacatctgttacatgccattggagtcactattcactgtcattatagttagagctgttatttctgttcagttcattctgctttcatgaaattcttctttaataaacaatacagtgttattaaaaagtcaatacacattgctatagaatccactatttaatgctttatgttctttttgaatgtatcattatattattctgtcacattagcctaatagtaaaatatgtcctaaacctctagccatgatagagtaattttgggggctgtaaaagcaattagcatctcatttcctcatgtttaagacatgttagattgtgtgatgcaccattgatatgattacagctgctgagaatttaaaaaaaaaaaaaaaaacactaccactttcaaggtaaaccttaattgtatgttacatctcaatttccgaatccttaaaatgtgacaaatgcacatcttagaattgcagtaatatggcaatgtattccttttctttccacgaatatgttacgtagctaaaaggtgaaagaaccctctcctgttctctgtgatcagaaatggtataatatttgcaaatactaagtgcagaattcacctgggtagggggacttctcaagatgccttttatggatgctttagttagccttttattcatattacagggaacatgagtaagagaaaggaatagctaaaataagtctgaatttaattgagtcctagtaaagggaggaatctataaggaaatgatgttaaggtacgtaggtaaataaatgtggtgctgattgaagataagctctagagaacaggagactcttaagataataaaatttgtttaaaaagagggggtggaaaaaagagatcagacagagaagttatcttaagaatataagtccctgagaaattccaagaaaatctgtggaaggtactggaaaacttgtgaaaatacgaaatgggtggaggagagaatagaggttaagtgagctacatttctttacccctgaagggaaatgtttgtaaaggtgttcctataggaccagatgatttttccaataatttttaccgttctaccattaaataaaaataatgaaaaatgctgatggtataatcagcagagaccaatggagaaggtttttccatcttgctactgtatcagtgaagtgagccgatagctgaaccctgaaccgaacatgcctttttaaatttctacaagcaattatacttgtagatatggggaatgaatcagaatgtattcttcatccttcccatcaacatggggcatgacttcactggaagaaattaactcattatactcattcttttataataaggaaattagagtagcatttacaaattatggctaagaagtagacagcaaatttgtttgaaatcatggaagttagtgcttagtatttggactatttatactggagctatcaaatgttacaaagtaacatatggaaaataatatgttagacattgtgagaatttatagtttaattggattttacttatgtcagatattttcccctctatcataaaaacccttagtgccaagtatatagtttgcgttcaccttctcttgaatctcctgaaggtggacttacaatcatgtcataggtcaagttaaaactgagtgtacacaatcttgctttttcttcagccctaaaatcgatcctagcagcaatcacattactacatgactgaaaaacctaaagtgtctgagttataatttagtgaatttagtcattgaatttgaacttgctccttcagaagagtagatcttctagaaccctctccacttctcacctcacaaggcagaagaaggcatgtatgctgagaatcggatgcttttgaaaaggaggaaatgccatatcttttcagctgtttctttccatctcgccaaccctataaataaggagctccctttgagaggaatgagtacaggtataaagacaatggccaaggcaatagctctaggttggttctccatacatctgaagatgcagacattcttgtgttgtgggaaactattagagccagagaaaatggttcgtcaacaacctcatcaaatgtattcttttagtttacagtaagaattccctgttcctctatggcagccttgtattctaactttcataccttctcgttgcttcgtactttgtctttagtcaatccaaaccatcccatgcacactccgccttcaagtgtcacctttcccttgtagtcattcatgcttattccagccatggctcatctgtttccaaaaaaaaatgtgatttttttctagtatgatatcaaattgttttattgcatttaagctttcctctgcagctacactgtaggcatgattagagtgaggtttgcaaagattacctcattcctcatctctggcagtgaatagcacagtacagactggatattaggcacctgatatacattggtcaattagtatttcagatctccagaaagcaagctcagcatagtatttaaaggctaagtcttatttaagtcttatttcttaagtcatatctttgattaaaaacacatttgagggaaaaatttaaggcctactaaattaacacaatattttttcctaacccaaaacagcatgtatacaaatgattgaatactggttccttattgttgaatagcatacataaaagtttaactctaggtctctttttttacagagtgtaaattgtcctgtgaatcacttttgaccattagcagttataaaccaccatcatatcactgcttttttcaaatacaagttgataatggtgataaattgaacatcttttagttttaatttataattttgtggaacttaagaaggcactagaaattagtccacatttcctattttgttcccatcaactgaacatcactggacattgtttaaattagctggaggaatttggccagatgttgacacataatggtttctgtgacccaggaactacctgcaacattatcccctaagttcaaaacttttgtgatctcttctgagttttggaaaattccattgcctttaattgcattgcttgtcatgtaagaaacaaaatctatgtacacaataactttttacattgatgctaaaatatagtgtcatctttatgaagacttattaagagataattagtaatccaaatataaattaagcttcaactttgtgaagggttacctttgtgaataaatcaactacagcgagatgccagtagactggaatatagaaagtagataattctcatttgcgtatatgtccatctctttgacaaactcatacttggatataagtttttgaaggatggggacttctctaccgttttatcccacagagcctagtaacaatggctaacatctatggttgtagaggttgtatactacaaaaggttgaagtcaaagtattaaaaggaataaaatctagtctatgtctactctgaagttaagctctaaagggtctgtatctacccaaatgagagacttctaataatctcccagaatatattgaggagaattacatatgattctgctacagtagtaactggcatataataggagctcaggcaacacttacgattgataaatgaagaaattgcttttatgaattgctaagctcacctgtgtgcaacaaatagcacctacatatgaagaaccccatgcatgatagctgtcgagttcatctggcattaagtaccttaatttcaggcatgtttttattgaaaaaatgtgacataaaaccatatcttagaattgaagaaacagtgtttttgtcttgcataaaaatttttatacattgtttcctcatttatttctcctgtttatccgatgccaaaggcaaaaccaaaacagaaagtatgagaagtgatttcgagtggaccaggaccttatggcgtggcagaaagacagccacaggactacttaggtatattataaagatagaaaagacatgttgagagtgactctatgaggccagcctatacctaatttcttactcttgtactgtaatttttttcttaagaaattagatgtaggctggcattacagagctgctccttgtgtgtttattaattgattatttgtatctggactttctccactttcctgttattgctgtttctcaatgattttgttttgctttggctttctgtgattaagacatcagctccactcgcaaatagcttttcaactcgagtgccaatcacagtctctgtatctgttaaccttattgagaaaggagaaaaagggtctgttgggctctggctcagctctctgtgaatgtcccacagctggctaactagacaggcagggaaagaaccaggcacagactcagtggaatgccgagtggccacattgtctgtcagccgtgccatgtaccaggaaaggggctttatgcagggcaggtagtaaacctttgtactaagatcactttttccatcactactctctatcttttttcatgttaaatgtgattgttttcatgttttataaatcacctcttaggaaatagtggtattctcttaggagattttagtctagggtatgtggatagaaataaggtctgtgaacttggattgggggaaaactttatctttatttgtattcaattaaaaccaaaagtaagcagttttttcagttaaaatgtgagcaacaaactccagcaatagagatacccatgactttgtcactaatagaaatgacagatacttttataacgtgttccagacattgtacatacttaaaaataccagttatgctcgtcatcactacattgaaattatcctaaagacctgatgctagatcttgttaattaacatattaggaaataaaacatgtattactacatcacaaatatttaaaaaatgtgttgcacattgtatttcagtataattgttttcatttaaaatcctatgtattttgttttatgcatttaaaagcattattatgagaatgggtttttaagcttcaacagatgccaaaaagatccatggcactaaaaggctaaaaaaatccctgctgcagaaatacagtagcaccatactgtagaattttctaagggcagtttcttatttgtggatggattttcaaatatctgcctttagccactacatgtataaattaaataaatataaatatatttagttgaacaatatgtatgtttattaaatatttataatgaaaaataagacatgaattatgcttatgtacatatatatgttcatagttacccaacaatgaagcttcagtatatatggtatggttttcatgattcattaatacatagttataggtttaaaaccttgcagaatcatagtaaccatacagaaagccgtttcataagcattaaatcttaagactacaagacattacttgaaggtcaatgctctccttttcacaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggtaagagaaaaggctagaagcttttacacccttctctgtcacgagaaaaagatacataagtgaccagtaacaattctgtgtttgaaaatttctcaattctacgtatatgctggctcttaattcaatatctataacaatattttaatatatttttctttatatttacgcaatattctatatgaaaataccacttaaaactaatctcaatgaaactttattgttgtcttttaaacattttagaacataggaaaaattctttaagaatattgtctaaccaataatgccatggtatgtctctgtacaattaaggaataccagaaacacatggaaacttttgaccagaatgtggaccacatcacaaagtggatcattcaggctgacacacttttggatgaatcagagaaaaagaaaccccagcaaaaagaagacgtgcttaaggtagcaaataaaatatgaaaagtaatgtccaaattgtacaccagttacttcaatcatctttgtcctaaaagatactaaggacgtcttaataagagtaaaacaatcctttcttccttcctttatctttccctttttccttccttccccctttgaatggaaatgaatgattttgaagagttctgtaatctgactttctgttcaaatccatcactcagttaattatacccaatgtaaactccgttcagaaagatattccaagatttattttgaaatcatattgcaaatttctgcctttgtcaatggtggtactacattcttgtgtctaacacaaagaacaatctgacactatcattcatttagcccatctgaatgaacacctgaaatccagtcagctgatttttttgcctatgccatatccaaatcttggtaattagtcttaatgttgggcttatgtaaagctgaggttttcatttttaactacatgtaaactaggctttgggttctttcttttagtctcaaaactgactgttaggatgccctgtcttctttttcaaggggaacttaatcttttctttaaaaaatgattccgataaaagggtatgagaggtgtaatacgcaaatataccttatagacactacattgtttctatttgatgatgtctcttttcccaattaaataggtagagttgaattttaacagctctcttttcaataaacattttttattttgttttgctgcaatgtttgataaatttattgattagttgtttactatttaaagaaaactcaaaaattatgtttctttctatgcaatttatttttatgcctctgatattttccacagattacgatatacctttaatgaaaaactataaattcattccaggctatccccaaaacacatttatgccattgtctgaagcttattttgatgtggatctgtattgtgctcttcattatcccttgatgtatagtcagagatgtcatcttatggtgaatttccttcaaggctttttgaataatagggtctgagttatttaacttcaacctctgtgacccggcaggtcaggaagaacattcctcagtacctctgtatgtgacagaaaattcgtatgtgttagaaaatcactttttttcttatgacactcaatgtaataaagaggaacttgaaagtgctaggaaggaatagaaaagtgttcttcagctacctgacctcctgagcacatacttagttcattccacaactattaaattcagtaacgatataataaaataagactaaatagaatatattatgatagttgcaacaacatagttgggaaaacatccctgtccttcctcggactaaataaacattttaaatagacatgcatcaaacttaaggacggtgatctatttttctgaaatcacacgcattttcattttagtcctgttttatggaagttgtggttttatctccctttgtattttctgcatgtgcttgctctcattttcttactttctctctctctctttctcactcttctcgctcacttgctcactcgctctgtttggctctctttttctatcttgaccttcattaattactaacttcaagtcctatctcttgctcatggaatatagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggtaggaagatctactccaaggtggaaacttgtgctaaatggtctcttgcgaaggttgcgcagtactctgaaaggggcaagtagaccccacagcaaggttttcaaaaggaaaatgaatgccaaaatgtatttaaggaaattttaccactgattataatgggagataaacgccactcctccccgtctctgtctctctctgtctctctctgtctctttttctctctcatcttttgctgccatagatattctaggactgcattctatgctgcagtttacatacgtactttcaggggtcacctacagaaaaaaataacaaatagcatgctgaaggccaaaaaaataaataaaaccaaaagcacacaagtcatccatcaacataaagcactaccgataaattttgccaaaagcagtactgatacaatattgcttgtatgtaatgtggatcaaatatccaaaatgaggtcttgtacatcttctgcacggtctagggtgtttttttacctctttactggttgtgcaagtgtgtttgtttaacttgcttttgctagttgtagacactgtgacaaaattcattaggctataatgaaatgatcacgccatgaaaacaaatcattgcaaagcttacatatcctaatttttgtaattttatatgcctatttatattactgtttaagaagaaccagggaatatggaacttttgcgtgatagactttatatttgtgtatgatttgatgaagagaaagtcttatttaataagtagtttgcaaaaatgtataaatatagtgttatagaatttcagctctttgggaagatttgaaatgcaagtaattacctagaaatttatatactgtagtttgataaatttcaatatatatgatatgctttcaaacataaaaatgtatataaaatcaatatatgtatttaggtatatagataattgttagaaataatctgaaatgaaaaaaacattggagtatttatgagaaaatatgatgcagtatgtcaggtaagtattgattcctggaaaaatagaacattttcaaaaaatattttgatagatataagcaaccagtaatagcatggtttcacaattgctgcactttctaaggcattacagtgtctcatcatgttatataatagtacatatttaaagtagttttcaaaataagtgaaatgtgacatgataaattctaaatagtttagcttgtatgcatgagacacagttacccttcaaaattcaccttcccaaattaaaaagttgttagtttaccttaattcattgcaagttatttttaatagttaactacttagttctcttgtactctctctctccatacatagagaccttatatagttgacttttaaaaggctatattctctacatatggagagagacagcatgagagaacttagtagttaactgtcacaaatatatatatttgagtcagtcattattacctgcaaaaaaatgtgacaggctcttaaaattgattaaagttttgaaagaatgtattgttacttacaaagacaattgtttttacttctaaagatatcaatggcttatgtaataacaagacaatgaatggagatttatttcaatccttaaaaaatgctactacttcattactaagatatagacacacacacatgcacattttaataaatcactaagctatagaatatttaagagaaaataaggtattatctttggataaattgtgttacaagattgtggttcacagatattaaaaaatgggtagaatttgctctccaccacagatgtgacagacccagccaatacaagtttgtgaccaagacaagtttgtgagttttcatttcacattctgcatgaatttgtaagtatacttctggaaatcatgcataaagtgatccactctatgaacttcttttattttccctagaaacataaggcataagaaatttccagtgaatattcatttattattattattattattattattattttgtgtgtgtgtgtgtggtggagactctctctgttgcccaggctggagtgctgtggcataacctcagctcactgcaacctctgcctcctggaatcaagtgattctcctgcctcagcctcccaagtagctgggattacgggcgggcgccgtgacacctggctaatttttgtattttggcagagacggggtttcaccacgttggccaggctggtctggaactcctgacctcaagtgatcctcctgcctgggcctctcaaagtgctgggattacaagcgtgaaccactgtgcctggccccagattttcaattatatgttaattaacaaaataatcacatgtttgcttttcaaagtatttgtttttctctaaattagtaaaggcaactgagtgtaacaatgaccccattttagggctctgaagagataattatgctctattatcacgatgaaatgaaaaacacagaaataaagcatatctgacactttgcttatatattcattgcatcagctaatgggattgagcttccattgtgttagagattgtggtgagaagatacaagggtataaagatccttgcttaagaaatacatgttttcaaacagaaatgaatacttagtataatcataaaatatgtttaacactaattcatcttcatggggatgttcaaataatggtgagatgatctcggcagagagaacaatagatttagaaggtaatctcaccagagaaaacagtggatttagaagattgagatttaggcctaactttttcagtagtagccagaatatgtgatttttctgcatatccatttcattgtttgtaagatgaggaagttaaaatagactaacaatttttaaaagaaaacctatcctgcccaaaatattattatttaaaataaagtattaaatttaaatatttaatattaaaatcatattatttaaaattaaattaataaattggaaaataatagagttactagatgggggaaatatctgccattttatctttctccttcctatgattgaattcaggaagtataaattatgctcatagaacatggtttgaaatttctaaattagattagttcataaatccctgctcgttctaaaatttggctattcagtaatcttttgttgattacaataagaaattgaaaacatttaatgtcttgtgtgtgtttgctctggagtagggaagtgctgaagtgctggaggttttagggggtagcctttgatctcaaaatcaggtttctttatagtaggggttatacaggataatattaggttagaatatggcttttctatggttgagtctatgtctaagtttcatggaagagtaacctggggaaaaaaaatactatggtgataaaaaaagtagatttggattgaacacgggtaggtcatagactctttgtaatcagtaatttcagtatagcctttagaacataactctaaagagcccttgaatagagaaataacttatgctgaaaattcactggtgtctagatttactatttggtgaagaatacaaagtggggtactcccatgtctcctgccaggactgttcatgacaagaaattccgaagcccagaaagcagtgagtaaagggatcctcagttcagattggctgaggacttgactgtccaagtgcagctctctgtaatgttaattttggcctcagcaaggagcagtatggtgagagcaaaaagtccttaacttcaagacacaagacctgctttgagcactagctgagcacattactacttagtgattttggatatgcctctttacctctcagagcctcatttctagctacaaaataagggagatgatgcctgttttattttaatctaaagattgtaatgaggatcaaattatgtaatatatgtaaaaacatgcatttaaaatgtattaatcagtgtatagatatgaaatggttaaaaataattaatatcaatgggtatttccatcgttacgtatattacacttgaatggccgaatctggggggttgagacaaaaactgatggaaaaaaatgaaagaattgctgattttctgtggtctctgctgtaatcgactggagtcagaaaatcgtgtctttgctattttcatgacaaagaccagccttaaagataatgaagtggatgaatttaagaactactaaggagttatgtttgtcccacatacgccccttaaaatacataaaaatgctgccttttcccattttattaaggttacctaagagtatccaatgactttgaaaaaagcgtgttttttcgtaatctatgtgaaatcaatgtgaggaaatggcagttttaatggagaggatcagaattgcaacagtcaatcagagataatattagaaccctgagtaaattgacagaatcaatgaggagagactccttgtctcaactgtctctgttttagggcatcggagtatagtggcatggctgagggcaagtggataccatcgggaaaataaggtgataggagacaaaagtataggaaggggcatgggaagacaaaaataaactgattatttattcatattaattatgacagttctacccctctccatccctctagaagccaagttggagaaggggagtcagcaatttgggagagatgctagttgaggtatatctaaaagcactaatgagtgaagacttgagaaaagggattaatcaggatgaattctcaccaaccatatattattttccgataacagtgtttggtagtgagggggatctattgctaggtaaaatacgatggattcaaggagcttactgtttgatgatagggcaagatgtgttcatggatactagattgagagtgagtgcatggtaagtgagtttagcagtcactccagcaacacagaggaggtaacaattcggcataaacatatgagaaagcttaggagcatacagtgtgttcaatgaagagtgagttcctttagttttcagagtagagggcatggaagataaaacttagttgtggatgataaggctgaagattatggctagacacagtgtgaagaggtcatggacagccagactaatcattcatgcttaattcagtatgcaatgaagagttcttgatgtgctctgtgtgtgtgtgtgtgtgtgtgtgtgtgtgtgtgtgtgtatctgtgtatgcactgttgagaaattagtccagtgatagttgtgaggagaattccactgaataatgacatgaagttcgggagctattgcagtagtctagatgagatacactgatgacctcaaaaaaagggatagctatgggagtggaaaggaaatttcagtctagatcagtaaatcttttgtatgcacttgggtgaattgttaaaaccagtgtgctgggccccacactcagagcttctgactcactaggtctggagtggagcacaagagtttgcatttctaacatttttctaggtcagattgatgctgaaggtctagggaccacgcttagagaactgctgctgcggagatatttagaggtagcctagagttaagtcattacatacaaggacccaagaagatgatgaattcaaaaatgactccaaatttaactctgattgactaggaaagtctgcatataaattccaataataggcctggtgcggtggctcacgcctgtaatcccaacactttgggaggccgctgcaggcagatcacctgacgtcaggagttgaagatcaacctggccaacatggcaaatccccttctctactaaaaatacaaaaattagctgggcatggtggtgggcgcctgtaatcccagctacttgggaggctgaggagggaaattgtttgaacccgggaggcggaggttgcagtgagccgagatcgcaccactgcaccccagcctgggcgacagagtgagattccatctcaaaaataaaaattaaaaaaaatttcaataataaaatatgcatcaagttatatttttattgttgtaatacttagctgcaaaataattttgactaaacaaactttaggtgtgtcatattaataaaggcaattattttactttttacaaaatattatgtaatttctacataaaatttgcttagattgtatttttctagagatttagatatacttcactgttctaaggagctgaaatgttaaattatttattctgaaattgatactaaccagaaaaaagtgaaattattttctctgactttgatcctttactaagacttatttgctataggatatatctggcatatgttctttaatttccatataggccttgaaaattgctgctaaaattcatgtagcagtttctatatatatgtattacaactgtaatatgagatttggacaatcgggcatcaaatacttaaatattcattgtttgattgctgcaataattgtaaattaccaagtttttttttttttttttttttttttttacttccattcagtgtcagaagatataaaagtaatcattctttggataagagactttcacaagtttataggaggctgtgagagagtcagtgaccttcccatgtaatgtagaatatataagaaaaagaaacacatgattgggcctaatctatcttaaaatatggttctatgtgtggaaaataattaagcagtgatttaattattttggctctcctaaacttcggtgggaaataaatgatgcattttataaatgtgatctagaaggtccaatgaagatgtattggattgaaaatttttaattaaagcttaattttctgtagtcagatttatcaatgcaaatacattgatattttgcagtctctttctgatcgtattataacttaacacctatgatggaaaataatattgtatcttaattggaacagtattcttgctatatatattctttaaattttaatttttttaatttttgtaggtacattgtaggtatatagatattcatttttagtaaaattttctataaaaacatgaaaactgagatgaagacttgtaaatattgcataatttgtagagcattaaatatgtaatatttacaactaatatcttcaggtaatagtaacagatcactagtcaaactgtataatatctgcaaattttattttactaaaatgaatcagaaaaatatgaacctaacaacataattcttatgttagcttattttttccacatgtgtaattggttatccctataacaaggttaagtccattgaaacttcgctaataaatccctttggtaaccatgtaaaatatttttaaagtagatgtgtaattgagtttggtgagcagtgtcatttgataaaactatctgggtcttgttagcataacatttgaaataattaaagctatttggtgaatcttgattgttctcctttgataaaggaaaattagtcccctgatcagtgtcagtagatgtaaagcaattttgctttggaccagagactttcagatatttataggaggttgtgagagtgtcagtgagttgaccaagttctcacagttagacagtgtggttagcaaatactagatctcagtccattgctttgtccacttcaatacactgactcagcatagtttactgcctctatttatgtcataaagtagtttttgttggtctactatgtgttagtataaacatacccaatttcacttcaaatacagtgatttcgttatactttttgtattaaaaatgacaagaacaaaaggtggtagggaggaagaaatggaagaaggaagggggaatggaagaaataaaactggaaaacaacctaagtaaatgaaaagaaagtttaaaatacaaaattgcttaaagtgttatgtttttacttttgtctgtctcccccatacattttagagttaaatgttttcctcttttaattcatttcctactccaaaaagtcatgtaatcatgaaatagggcaatattctaagttaaactttataaaaggtcgacagtaggaagcagattcttgacccacgaatatattttgcatccagttttaaaatgtgtaagcatgaaattaacctcatccatacaaaatcaattgaaatctactgggtaatatcctctaattagcctcacaaattagtcacattttcacatttttattatcaaagcattaaaggtaaaccagtactttatctattctcaaaagaatgcaaccaatgaaatgtcactatttggagtcaatttatttaatttaaaaataatatttcttacattttcttgtttgctctaataattttaaaataatagaataaataagtttataaaccatattttaaataatctttcttctagcatagatgtagtatctttccaatacacttatttgtttttgtaagttcttttcctctacagatagaatgatgtgaaataactcttcatatcatatcagtagtctgtcttttctgtactatagtgtgttacttgtccttgaaatttttcatcttggtttccatgaattctttatttttctatatcaatattgtaatgataaataaattttcaaagctgcagaatggaaaaaggagactgatggatttgaagcaattttaaaccaatctgtagcacttggattatttattttcaatttaggttttagtgtgatttgaatatagtggtaatttatcatgattattaagattccatagtccagattaacaaatgtttacttgctgtctgtgtaaacacagtcgttattatgctagtgtatctgtgcatgccaaagtaatatttaaccaaggaaagcttacattttaaaactaataaagtgtatctgagtaattttgaatgctttcaatttacaatgaatcagtttgtaattgatcttgcttttcttcagtctgttatcctttgttaacttgttataaaattcagctttaatgccaaaacttcaacaaagccttaaatttcattaatccttaaataatccaacaaagcacaattaatagttgttaagcaatttgaaacattaaaaaatcaaggaaaacaaagtgttgtctttctcggtttctctgtctcttctttatgtgtccatttatccatttattatacttccctgtcttctaatttatatgtattttgtatgactgcacagtcatgctaaagctcttaaaatgaaaaggtaagtaaaaaattaaaagtgtccaaaacctatgcttggtatacactttctcatgcaatattataacttttgtttgattattttctatataactaaaacctattttgtgtgcactgtctaacattgtgtgatttaattgtgattccagttcttttgtggtcatctatttcctttaaagtcaatagaagtaacttacccaataattaagatgatttatcagccattgctttcaactgttttagacaatttatcataattctgaattgaaaagcaggcatgatatactttgtgttttaaaatttggtgactcaagaatgagctgttaaattataaacgctttcttattacatgtttcctttataaagttgcataagaattccaagttacaaagacagggaagaccaaggaatgacatgtagaattttaattgggtgggaaagtgttttctgttttagaatgggcatagcctaatgctgaactagtgaactcttaagaaaagcaatgaatttttttcatctctttgtgtccaaagactattaatcatatggctgtcaaatggctggtgctatcttgccaataacatagctaaaacaattggtttgataaacttattttggttataaaattggtcactggttgattaaattaatatataggtagttctaaaactaccgattgatataataagcaccttttcctgtataaaataaaaggcagtgttttcactggaaaatagagtagtataagacatattgccaactttaaggatggaaaatttatttagagagacaagcatatatctttgaaagccaaataatattatattcctgtctataagaaagcagtgcaacacaagctgagatacacataaatgagaatagaaactcctgaaataacaggtcaatcccactcccgtaatttttcctataccccgaggactgcctgaaaatttcactcagaacacataatgcaagataataagaccgacgtaagaataatctaaattcaccacaagttataaacaaaacattactattttattcaaagtaattatgagatattagttctttacaatgttatgagtataatggttaatagagctctatactgcctaataaggtggtcatgaaccacatgtggccactgagctttagaaatttggctactccatgttaagatttataaataagtgtaaaatatgtgtgggttttgaagagaatataaaatgtaaaatattcatatttttgtattgattatgagtttatacaataatttggacatctcagtgaaatcagtaaaattaattttatctgttttttgttttttactatggcaactagaatatttaaaattacatatatggcatgtattatatttctattgagctgcactactataaaagttctacttgaatttagagacaagaacttactgtaaggttataaaattttaagaaaatgtctgtgtgaaaaggattttgttcctaaaatgtgactgaatacatcctcatctagtctctgcttataaacatttagcattacttgaaaatcagtgtttttaaaaaaattgcagtcctcatcagttgttcttatataaacctaaaatttaggctccaaataatttttgcccactgattttagttaatcactttgaaactacacaaaataaaactactcaaattcttaatcttcctaatttttttaaacaaaatgcacggtagtctttcattggaaaatttagaccctacacattgaactaaagaagtctaagtttccattatcttgcctgaataattagcacttcagtttttggtagtctctcccaaagctctttttacatcttcccccttttttgtgtttacctggtggtatcatgttgcttagcatttgggcagcagttaatatacatactcatataatgctaaccagtcaggtcttttgacatttctacatagaaattgtgttatttaaaattccatgtcactaaaaaagctccttgaaatgtctattttggccctcaatttttagtcttttgttcatttattttttcaggaaatatttacttatgaatatttactatgtaccagaaatgactgtaggttgaacatgagaaactcagctccataggatgtctagggaacacaccccactgactgtatctgtggtatgccttttctgtctccaaataattcctgattaaaaaaaaaaaactgcaccctgtaaactaaatgcaaggctgtgatatcactttttatattgccgcagataaattaatctgtagttttgttcttcaggattatgtaactctaccaaactggaatctaaaatcctccatgttcaccattacaatgttatgatttcatcaaatcccttggtaaaataaagactcattatatcaataagcatgtattttatcctttaaaaccatagatttcaaaggaggaagggcttgacctgagccaatggatgattaggattttgagaggatcaaaataagacccaagatttatagagcatgtatttatattggatggacacatagaagtttgagagaaaataatagtcaacatttattaagcttttattatataccagacaccattctaacatatttgatcttagtaatagccctgtgaggtagatattcatcttatctccatgttataaagaaactgaggttcaatgaggataaataacttgtctaagttccctcagctagtaaatggtagagcccagattcaatctatgcattttcatacagaagtttatgttcttcactagaagatgaaaagtattctaaggtcattgaaggaggcataacagaagatcaccaaatggcctgcaaaaaaaggtctatattaggaacacttacataaggctggcaagtctttggggcaagattaggagaagccttgactactgtgctggaggttggactttattctatttatactcaatagatgcaggaggttcttcagcaaataaatagcataatgaaagaaaggtttttgaaacatagtaagctgatcattgggcacaggctggaactggtttgactgaaaggagattttacatcttttcaaagcttattgccttagttttgtgtaaggaccaggaacgatggagtctctgggaatacaaagcaagtggatcatagcaagtcaattgacacttacttgatatttattagacattagagtgagatgttcaaaaatagcatgacttacgttttacgcctgaatgactgagagaaatggtcttccattaagagaactagggaagttagtattgtaagcagtttgcgggaaagataatgtgctccatactaggaatgtgaaacttcaggtgaaaattcagctggctattggagagtctagatgggaattcaaaagtcagataacagcttagggtgaagacttggaaggcataaaaaattgttaaattcgtagaaaattgtatcttaaattaatagaagttaaattcatggagagatgagctagagaagaagcagttggaataaaacaggtaaatctgactgtaaatagacctatgttcttctgacatccaagtacacaataaaagttattttcaacattatcattatgtattcacaaaatcacatagaacatagttgctttcattaaatattagcaaatgtgaacaaccatttaataacataaaatatcaccaaattgataattgtatagttatgattctaagggttgttaatctttttacttttaccgtcatctaaacagtgtatgattttattgtaccgtaattgctaataatacagacattgaaactttaagcatgtttgtaccactaccaatctatactggttcaaataacttatgatatttcaaatggcaaatgatcattaggatttaaaaactggtactgtaataggtcacttaaaattatctcataaatctttcaggggtgtgtagaagtacctagaagatatgtggttattcatgttgcatatgagaatcatgtcatcatgaatagaatttgattattcacttcttcaatagtgacagattattacctttagatatttagtttttcttctacacttatccgtattgttcaccagaagttgccatctaataaaaattcaacctcttcctgggaatgtgactggagaagggtaggtggggaccaaacttgatgaatgtaatcgtcttggcaaaagacacgggggtcattcctgaattggttttacaaaagtaaaatgttttagctctgaaagaaaatcagatttctgtatgtcatctatgggttttcaagagctatcccatataaaatatgttctagtgttttaatggaaagaaatacagcataaagattgagagagtatcaatgtattttattaacagaattttaatctaataactaaaccttgcccacttttttgaatatatatttgattttccatgtcttttcacttatcactccttttcaagggttttgtttagaaagtcaagagattttaaagttttcttagactggtcattatcagttcaaaagtaaagaaactgatgtttacaaggttgaaaagcatagattctttatgtgaaatatattaggttcattcgtttgaatttatttgcatcaccaaccaaactgttcctaaggcaagctaatggcattgtcttagaagagcatgcctgtcaattgtgctgtgctaaaaatgtcatttaaaacatctgagcagattgccatgtagtttttctaaggataagatgacaattctgcatttctacctgaggttactgttacttgataaatgaggcaatttctgatgagacatatttacccaaatgtatttatatcagaatatttaaaataaggtcaaatttgactttagaatattaaaaattagcccattcaaatgtatctgtaaattgactgttgttgatatcaccaaatgatgaattgtactatcttgcatgtatgttcagctctggtgatgtgaaatgtttctccttatttgcatcctcaggtacttttccagttgtatttcaaaacccttcataaaacataatatggaaacataatgcatgtgattagtttagcaacaggaggttgaataaatgtatttcttttggtttatgtttctaataaaaagtaattttgatttaaagtagcactatctttttttttaggcctccattcctttgaaggaattggagcagtttaactcagatatacaaaaattgcttgaaccactggaggctgaaattcagcagggggtgaatctgaaagaggaagacttcaataaagatatggtaaattggttgtgataaaagtgtgaatgaactaggagtggaaataaatatttggaaagaacttagataagtctccaactgaattttcagagcacatattacacattttatgattctaatgaattttataaatgcagaatattcttggccttttattacaaatgctgaattactatggtatggtaatataggagcacttacggtttctaataaatagcccagcaattttcttttgacctgacctacttttgaacttatcaagggcaaaatgtaattggaaaaaagagtcgaatcataaaataaactaaaaatttaataaaatactcaactatcatagatgactgacattttgtatcagcaatgtttttggtagtataacatttatttcaatgaagagagaataatgcataatatgaacattatttattacaatttcccacaaagttgttttaccaaatagttgtttagttagtacattatatgtctaaaatgtgtataaattcatgctgcttatttcatgggagtaaagaaatatgaccatgtgtgctcttcccaacctcagaatattctccttcaatcccaactaatttcaaagtatctactacatttctctctggcttgaatatttgtacatcacatccttattaactgactttttttttctctcttcatcctccttttcacaattttttcccctctttcactgccatcacctctgtggcattcttaacctttacaattaccagtgctagagccttctcagacaatgcttgaaagtgacatcagaagacaatatataaattttaggtaataagtgtgtgaagcaataggagaactattcccaccaatcttagttcccacttcctggagctgcctcaatcaatactccccatgtatggggtttggtggccttgccaactcagcttgtggaaagacggaagaggctttccaagttgctgagttacagcaatctctacttcaggtcaaagaagaaactagagggcaccaagatgaaaaaaagtactgattacctcttgggctgaccccaactctgccctagagccctcaactggtatagggaaagaagtgaagtgggttttttaattttttgttgtttttgtcctcagccctagaaaatgctacagacttttacaacaccttttaaaataagtaaagtcttttacagactataagtatatgatgtgtctatattatgataagtatataatgtgtctatattatgccgtatgtttctttagattattgaccagtctctgacaaaaataatccctttcccccatacaaaatgaatcagtcctcagttgcgtgttgaagtttatgcattatagatttaaatatataacatctaattccttgaattgtaatacacacatacaaatacttgtgacttttgaaatttattatttgttttccttatgtcatcagtgtaccttgagtaccattacaatgtgagactacttgatacaaagttttcacattctgagttgaaagaaagaaaactaaaggtgaaaaatcacatggtcatatatgcgactatattagaccagcatttattcaaaacattttatttctaagtaaagaaaattaagatattgttcttgcagcctaaaggaacaaaatacccattgaaaatgtttaaagccattttccagtccatattttagtattatttgatcgtatttaaattaacatgcatatatgacatattttagaaattatttgatggtaacttagcacatgatttttattaatatcctgatatttctcctattaatattgagcatttaggtttcagaaatgaagcaggagttattagataggaattagtgtacatttaaatcaaaatattttcatgtagttgtgtgttaatattttcagatttgctgttatctcagtcacaaatacacatctgtattcctttatggatcagttaacattataaatgataactttagctcatttctctaatgttttaatttctagaactacactaaaaaagccaaaagaatactttcacagtaattcatgacttgtctgacatgatgaagtaccacactcccccatctttctacaggtgcccctaaaaatgtgttctttacaactagatgggaggaaacttattttgaaacctcaagtaccaaatgtaaaagaaaggctatgagcacagtatcttataatagcattccatgaaagttttaaattggatttttgtgtgtgtttaaataacatgtcttattatctctgttaacaatgtacagctttttaaaaaccaaaatgaagactgtacttgttgtttttgatcagaatgaagacaatgagggtactgtaaaagaattgttgcaaagaggagacaacttacaacaaagaatcacagatgagagaaagcgagaggaaataaagataaaacagcagctgttacagacaaaacataatgctctcaaggtattagagctaaaattataatataccttgcctgtggtttttttttaatatatagggtaaaatataatgtgcattaataaaatctgcttcagacttagtcatcagaaactcactttttctgttcaatgtgtatgctttatttaacatttttgagtggtatttgattttgaacgatgtgttgcttaaaagttatggctttttaaagacatatttttctaagtagtaattgaaagatgggaatgcattcatagtacttatacatttaattttctaatgtgctttatttttatcagctactttatattgaaaaaaacctgcctaactgccagaataaccgatctacatgtatccattattcctgctttctttacttaattgattttgcttgcattaggtccaattttttggtaacctgatacttgtttaataagccctagattcttttatttatttttaaaactttattatgcctttaagaaagtcactctttgcaactatctacaaagtcaaatttcatttatgtaggaatcctaaaaaataatcttagtgcccttgaataagaactgctactttcatattaagcagtgtagtgtatggcttcaagtccccaggtgactcatctggtttgtgcaggaagagcaggataaacttaatttttctataataatatctaggaagttcttgagactagacatgtggaaagttttgtgaaactttttttttgtatatgctttgcaataatcactatttgcatgcatggctgattttctaatacttttaattgctgagcttttccttgtaaatcactcttttgagctatgtagttatgaaggtggatccacctagcaggtagatggagtctgctttctacatgcaaataagagaataaaacctttccccctatagtcaaccaaataaacactgctgagaatgtaattacacaatattgtgcctgcaaggaatccacaaggaaagtctaattggccagcaggtgttctgaaggtaactgctgataaatatagtaaacagaaaaggcctcttcctcgagggagtgcaaaagcacaccataatgtgtctagaaaatcggaacgctatgtaactcacacccttccaactgtgagcaagctttcagaagtatctacactggtcgtatgatggtgtgtgtcctactgaatagcagtgtttaatggtcatctggcattcctctaaagaaatctacatgacatctctaaatattttacatattatacatcactttgtgcttaggaaatgaaagatgtttcagattgatgaccaccaagccctttctcctggcaaagatgtgagttatgtcacaaataaggcatggctcaactctaattcacgtggctgtatcttgctacctttgaaaaaagcagcgttcgatctgactcctcagaaggtttgaaaattcaacataaaacataaagtacagcaaggtttaaattcccaattttaaacaaactagataatgaaatgtagttcattcttgcaaatacaggctataagtgattaatcaaaatcgtcaacactactcgccaaaccaatctataccaacatattcaataactttttaaacctgtcaaatagttccaattctggtccttatgaaatattttagagaaggtcaaaattttccaatggaatgaaatttttagaaattccctgatatttattattttttcgctcgaattaaacctgtgaataaaaccctaattgctactttctgtagaaatgaaagctgcatgcagagcttatgttcccatgaattataaaatggcattttgagtaattctattaatcacagaagatattgagtgtgcttgtaaagagcatgatgactgatttcctcccattgttgatttattaaattagtcttatcacattgatttgaaagcatgcacttgctgttttcttttttcaaatagttaattgttttgcatttagagcatgatttggtatagtaagataaatgtggctatgcaagccttggaaggagaagcatttatctcacataattttttattagttatgttcaccaatatacgaacagtggtgacacttctacacatacagcttggaacagtttataagacaactaaaatggctttatatttctaatcataaaatattaatggcctatgaaactcttatgtaggcatttctaaaaacatgaatgtatattggttgagtacataaagttttgttgatgagccccaaggctaaagatatacattttagaattttacctattttaagtcagatacaaactcactaggtttgtgagtttgtatctagttaagtcaattgtattcgtatattaaactcttgcacataaactacacaacagttagctcattaagagtcaattgaatgtgacaaaatttttaagcaagtttgaacatgctaagagaaaatactttaagtgtgttattcaggtttcttagcttcctatacatgggtcccgcctcatgcataggcaatttaattatgtctttgtatattttgcatttaaatatgattttaacctaagttgtacaaaaagatgagggacgcaaattattttgataaataactgcagccagaagtgcactatacatatatattgatattttaataatgtctgcaccatgaacaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggtaatgttgttttagaatgtcaataccagattttattatacagtttaattaacctgtgaagatcatatttaaaatgttgatgttcttgtttctattaacgttctctttgatttgatgcatttccttgtattgtgtgttgttttcagtaaatgtattgtattaagtgttattcaattgacgtaatgttgaatgaataaaatgttttagactatgtaaagtgatttaagaaatgtgatgtgttttctggtaaaattgtaattgactttgtgtatctttgttccagatgaactaatgacttatcggtatatggacgacttcttactcatgttagcccattcatttcatcagagcatcttcacacatcagtgttcactctctatagatttatttgcatattgtctaaatatgtttttttctgttattattttacactttttattttgcttcattctctgttgagttcctcaaacctttaaaaaggaaataaataacttattcacttaccctctaaattatattctatgtggacggtccctaataaataatgagttatcactccaaattgtttcaaatcccaagacaccagaggaatttagaagaaagaaaatgttagaccaatttcaatatttacttaattagaatatctaaaaccaagcattcaaaggataactgaaataatatttgggttattgagcgaggatgacagtcatgcctttcatatttgtaaacttcaaaggatgacaataaagggacaacagcctttgaaattttgagagaagtatttgctgcttgcaagtcggttgatgtggttagctaactgccctgggccctgtattggttttgctcaataggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattgtgagttgttactggcaaacccacgtatgtgtttgcaactactactctattaacagaggcctactaataaaaaaaaaagagacaaaaaatctgggtacagttttaaacttctaatgtacattctgaaagtgagtggtttccctcactttgggcttctgtaacactagtgcttaattttgccaattaaagacacaagaaattaacagataacagggaaaaccccttatcaaaaatgaaaatacatcttaattttttttgctacatcatttttcataacattggcaatgttaatttgtcaatttatcatacattcactttacttcaatgtctaatccaaaaaatatgtattgctttcctgagatcatcccatgctgattttactttcttaatgtatacatgataaataataaatatttcatggtacatcttatgtcaacctgcataagccattatctcattgacttgaagaataatagcttaatcctcacacctggtttaactacttaatgggttacagtgcccataaaagaactggatgcctagtaagatggttgctaattgattgcagattgaacaatatcagataatgttattactgaaatgttaccagccaaaacaaaaaggagtgactgctcttctttcaaacaactgaatggaaagtgtatggttctctctttaaaaaggcgattcagaattgttagcttggtctcacttctttatttgtagtaggtataaaccatagaggttttctgacaggtacatttttgttcctattattaacacttgtaagatgaagaggaatgatcatcatctgtaattatagaagaaagtactcctcacaaaaccaggatgtcaaaatctggaaactaagtctttatagttaagttaggttgaattatatgaatcaaacagatactcaaccattttgccctatgtaaataataactgcatagggttcagcccatgtatgagacttcttgggaacttcttctgtgatagtgtcagttccatttaatttggtgtatatttttaaaatgtcaaaagcagttaccataacttaattttataagcatataagggaagtatgttgcatattattgtgacttcttttaatacttcaagaaaattaataaatacactgttttctgttaaatctaataccctaaagtttaatagcaggtgaattattctgagcaattggaagaatacgagaaatagcgaaactgtattgcatgtgaagtctaattccacctggctgaatgtttcagcctattatccttcatattagatgttatgaatgtaatgtgtcataaataaccttacactaaccagcaagcctgtgtctgcagatgcaaaatgaagcgaaagattaaggcaatcaaaaagaaaattctaataaaatagtttcacctcaatttaatagatcattcaagggggagtcctttgctttgaattatctgactactaactcatttctccattccaattttccccaggtcttgacacacccaatatgcaggtttaaaattcgttacaaactaatcaagttgctaatgctttatggctaaataggcacaggatcaaaaatctccataaaccacttacttaaaatgccattatgtccctattcatagtaggctctcaacaaatatttgtacaacgtaataatgactggtgaaataaaggaagcatgtgtgaaccagtatatatttttaaaaaattgtagtaaaattctgggatatattttcctcataaacgatttattcttaagttttatatattaaagatccaaaattcagaatgtgaagggggctatttttgtgttaactcttaattatccatgataataaagtaatcacaatctgtatgaagaataatcaatttaatattgcagttatatttggcatcgtattttaattagaactgagggataattgatagatgataagtaggtatataggttggtaggtagatagatagacaggtgggtgtagaaatattcaagatacatctttatacttgaccaattgtcaatgcattttaaaactaatttcactgtggccactgattagagttatctttcccaattcttacgccctagagtcatttgtgatagtcacagtaacagcttaatgaaaagtagtatttgatataaccttacaatggctctgatgcagcatatgccatagcttcagaatttcttacctccccctatattctccttctctaattgtttgatttttacttttcctaactgtccctttttgtttttctagatataaactgtaggcttaaagttcatctttcatgtctttacagcaacatgttgaaatagtaagcggtactcttaaaatgcttagtatgtgagagctgagtgagtttaaaatgaaaaattaattttccttatctcacagataaagactcagagaagtgctaaccactgtaaaattaaggcatttaggggactctgtccatgtcagagctatatatggtagtaataaagctcagaaaaggactgagactttgagggaacaatcatgaggcagcgcccagccacacaggaatgcagaccaaagcatagtagagggtatctgcaaattgtggtcctcagggcaaacctggagatgataaagaaagaggcatgagactgggaggacgcaggtaaaaattttaccagatattcaaaatgagagaactcctgccttaattaggaattccaatcatttctaatatatttcctgttggtttagaaactaggttcctcagttaagaccaagcacggactgtaaactgaggaaaagggatagttctataggatgtactatcacagcagtgtggtctagtaaaattaactcttggataaacagccttgaatatgaatcccagtgactttgagtgctgtatgatcagggataaactgagtctcatttacttcatctgtacaatagagataaggatgtttctgaggattaaataaggtaatatttgtcaaacacctgctgcgttatgcaggctcaatgcatgaaagttttcttcgtctcctttctgtatatatattaacattggaaaatagacataatctttaatttttaaaatattttcataagtcattaagagaattaagtacgcagcatttgtttaaaatgttaacaacagatatctcgttcagtgaaaatttcaaatttaattctataatatataagcagatacttttctctagattcacagaataaacacaggaaatatcacacaaatctgatgactgccaagaaagggcatgattttccctaaactgcccctcacatcattgtagcatttggaaaataacctcagagagcccaggcatttgcaaacacaaaattatacaatgaagataccactacaacccccaagggtcatgtgaaactgctaaggaacataagcttacaaactaaaattatgattattgtggaaaaaaattataagcaatgttatcagatgccaaacgttaaaaggagaatgtatacctgaagaaaatagagataagaggataatcaccaaaggatattaagtaatttttaatgttcaaaaataaaaattaaatggatttttttccagtaagaataggccattatataaagtgaaaacgaagatttgaaaaaacaaagtctggaaatgaaaatataattaatccctcaaacatctgcgtgaaataagtttcaagttgaaaaaaatagggattatggggaagagacaatatttcatattaatgaaatttaataaaatggaataaatgtaaattttaatgaatcctcaaattcaataaaggtcaaccaacgtggaaaaaataaaaacaagtctaccagctagctctgaatgaaactcagagcatcagtaatcaaaaaggtatcattaagggttacttaagacaaaagaacatttacaggatgacaatattgactgaagacttttcatcaacaatagatattagaagacagttgaataatatcttcaaaatgctaggcacattttcaaataccaggtaaaacatgattcaagaattaaggcaaaatattctcagacatacagctagtttcacctgaacaaaaactaagaatttcttgtctatagatttttgctaaaataattactaagcaatatatttgtgtaaaataaaatgaaactagaaggaaggagacagcgatgtaaagctgtataaaattgttttctctgtaaataagaacatttattaaaaaagcttataatcctaaaatttggtcagtgccaccaaggaaaacacagaatactaggagaatgcagtgtttgactgatcctgtgtaaagagagagaaatcaaatagaagacttattgcatatcctatgaattacatatccttaattcatatcctgcatattacatatgctatgtaaagggagataaaaacaagacttattcgagataatggcaacaaatataaggcttgtgcataatgtgttctatgtaaattattaccaattataatgtttctagatagcaaaaaagtgctaaacctctgaaatatgtatacatacatgacctttccaagaacagcagcaaaaaaatacaaaaaaaagcccacttcagtgaagaaaaagaaatgtccattttctaaatacatttccacttgagctgagcatgttatgacatcaaataccaagtatatgatcttgatgtttaacattttatatccaacagtctcttatcttggatgcctaatgagcatctcaaacatacaatagccaagtgaaaaataaatgatccaccccccatctacgttaattggcatctaccaacatctccagatgttattaaattgcactattatttacttaagtcagaaacctagacatccttcatgattcttttctcttacattaccatgtaaattatttccactcttgttggatatacctgcaaaatgcatcaaatcactcctccgtatctgttatggaagtgctaatctacaagattattatctctcatctggattacttcaacaacctctaacctcttcttccagtctttccccacttacaccatatttctcctggtgaaggcagagagctccttctaaggagttaatgagatcatatcaggcccctcctgcccattactctttaaatgaaatcctgtgatccgctatatgatgtagccccttcctatcacttctgttactcacactttgtctccctttttgctcttctgctaacatagaggcctaaaggtttcttttctatacttaaacacaaccaatttcatttccatatcagtatctttgaacatatttttctaatggaatatttttcacctagaattttgcataggtgctataacttatttagatatcctttcatttaggaacaatgaatatttagtagaactttgatgtataatctggttatgtaatgtagtagtttctgttataaatgttttatattccctatacttatgtatgcaaattcggagtttaagactgctcgttcagaacatcagtttctcttacggttacttctagaagtaggcatactaaggaaagacacagcttctggaacataaaagtgaggtggtaaaagatgaatatgaagagggttacaatattgtattgcaatggatagcttgtcctacagcagagtaattgtaatgggatattttgacaaaattaaagtacacatttccaaaatatacatgctcttggaaggctgatagaaaattaaccttgtttgtagattaaatgctgcaataaatgtgttatttaaaatagtccttggctgggcgtggtggctcacaactgtaatcccagctctttgtgaggccgaggtgggcggatcacttgaggaggagttccagatcagcctggctaacatatataacatgtcatgtatatatatgacatgctatacatatatacacatgttatacacacacagataacatgttatacacgtatgcacatgttacatataacatatataacatgtacgtatacacacgttatatataacatgttatacacacgttatatataacgttatatatacacgttatatataacgttatatatacacgttatatataacgttatatatacacgttatatataacatgttatacacatatacacgttatatataacatacacgtatacacgttatatataacatacatatatacacgttatatgtataacatgttatatataacatgttatacacatataacgttgaatataacatgttatatatgcacgttatatataacatgttatacatatatacacgtgttatatataacatgttatacatatataacgttttatatatacatgttatgcctatatacacatgttctacgtatatacatgttatatatacatgttatgtatataacatgttatatgttatatatacatattatgtatatgttatgtatataacatgttatgtatatgttatgtatataacatgtttgttttataatgttttatatataacatacacatgttatgtatataacatgttatataacatatacacgttatatataacatgttttatatataacatacacatgttatatatataacatgtatatataaatgttataaatacatgttatatatacatgtatatacatatatacatccatatataacatatatatacaagttatatatatatgttatatatatgtattatatatgttttatatataaaattagccaggcttgctggcagttgcttgtaatccaagcttctcagaggctgaggcatgagaattgcttgaaactgggagacagaggttacagtcagcagggatcacaccactgcactacagcctgggcaacagattgagaccccgcctcaagaaaaaaaagtagtccttaattgaataaatttgtaaaataaacacctatatattgtgaatatttttccactaacttttttaagttgtttgaatctgaatagtattatacattcacaaagagttttcacatgcatctagtttgatcacagtaatgaccctctcaagtatcattttctttgtcattttactgtaagaaaaattagcataaatgaggttaagagatttgtccaaggatacatctgagaaatggaagacgccaaacttgaactcactgctttccaaaacatggtgggagttattaataaaaaaggaaaaaagtttcagtgtttaaacaattttggtaaacagtagattaagcaaactttccttactctataactttctagtgcgtttgatatgctaatgggattatgactttctatgaaggggttagattctatagactttcacatctagacagttgcagtagaaaagggaaatttgatttcagattgatgaaaggtttcttatttgagtgatggtgaaataagaatattctttagaaaaaaatgggaagaacatcaccgtatcattattcttctgttgtttgggatttccttaaatttaagcagagatgtacaagaaaagtaataacagaactgtttgccaccaccttatgtaaaataatgtctgagcctagatttaatggtctgctacacattttttatattgtctcctatcttgtaataaaagcaactcattttgagaataaaattaggggaaatatattgtctttgcataattgccacatagattttcttctttgccttgaaataacaacaaagattgtcagctgccagtgcaacatccttggagaatttgggaagataaatgattttcttatttagagacagaatgttctttagcaaatggaattgtaaatacaaaagactaataatggttgttaagggaaatgttgcaccaggatgtagctgtttgtagaatttttctcctctcagctcaattttgtaattaacatattacaaggattaaaaaagaaattagctaacattttatgtttttctagattgttgatgatcatagtggttataaatatttgtacggagtttttttgttctagtgtctagttgtgtagcataatcagtttaatggttaagtagaggcatgttcagcgagtatcagcttccagaaagatgacagactgacttaattcctcaccccctcacttcaaatgcgtggaaattctgaataaaatataatttttaaaagttttaaatacacagctgggctatggtggaacctctcttccctctgtgtgccatgaatgatcaaatcatcttacgtgaaactgaacctggattgagagcctaatggctaggaagaagttttcaagaccttttaggacaaaatatgtgaccttcaacaacacataatatagaggtgaaaataaaacccctccttaaagtctgaattttcaagggcttccctcagctgtaaaggggaataaataaatcctacccacaatggagaagaggcattatctgtagtgataatagcttaggattttcaaaacttaatagaaattccaatactccgattgggaaactgagcaaatctgaagcagaaaagattattaaaaaaaagaaatataagtatagatcatcactatgagacgatgaatctgatgaatccaaaaaaagcaaagaaataattttaaatactgctgtatttccttagaaagtagtgacacttaaaatggtacctggttttagagcaatgatagaagccagaagacggtagaataatattttcaaaaacaatgaaagaacatccacgtaggaacctagaattgtgtactgatagaaactctctttcaggaataacattgaaataaagatcttttcagacacacagaaaccgtttactagcataaaattccctttagaggacgtcaagattggtctttaagcaggagaaagatacaagatggaagatttaagctgcaaaagaaaatgatgtgcaaagaaaatggtaaaaaaatggaaaagtcttaaataaacatttaccgtgtatgaaagtgtctattaaaaaacagaaaaatgctggacatcaatgaaacatgagaaggtggttaagtttttcatccagtttacctgctacctttctatgtattgtttctcagtttccataggtagtacctacttctctaatgctgaaatgcctcagtgctcagtccttgggcacttgccatttttatttattctatatatgtcttgctgttttcatccagcctcgtgacttgattaaaacaaaattattcttttcccctcaaatgcagtggaagcaccgttctttcaaattttcagagaaaaaaaaaaatctacgcatgctttctttagcctatctctacacaatacacagggacaacatttgaaaaatataaaccatatttaaatctgatcataatccttcaatgaattcccatctatttttaagtgaaatccaaaactcttcatgaatttcaagggatatctgacctggctggcccacttcttaactcaggccttatctcttaatactttcctctgctccacctatgttgacccctttgctgctgctttcacagatctgacatgcacccattgcattgtgtgctacctctgcctaaaataatcctcccccgtttctccatgtggctcttttcgtttctgccttaacttctttactcaaaagtgtttttttcaatgaatctttctcatgtgtgcacatacaccacacacacacacacacacacacacacacactttttatccatgctttcctcatttatttttctcaataaagtgcatgaccaggaaagttctcaatattttccttctttatcttcttgagtatttatttccctacctagaagtagagctccaacccaacaatgcaaaaaaaaattgtctttttttcccactgctgtgtcctcaacacccaaaacagtgactaggtacacagtatatatttgtttaattcataaaataagtaattaatcaataatgaataaagcaattttaagattctcttagtgcttagaatgaaaacttgcaaaatttcttgtgcgtgttaagaattttatactaatcattaaatcgatagaagtatacaatttttgaatagtagagggaaaaataaagacaagctattaagttaaagcaaataatccaaatagaaaactgaggtttaagaacattaattgaattcatcaagggtagtaagaaactatatgaacataggattttgtgttttccgaatatctctagtccaaagccatcactatgtataaaataagatgttaattacagtttaatattcttgtaagtttaagcaaatttaccatttatacgtgatttatacaacatattacctcttgaatattgtctcaaatgactggcttcaagtagcacgttaaataaaaatagtagaataaatgtgtcaagctacacttactattcacaattattttatagttagattatggctctgttagatatacaattttatatttgcttatcttctgaattaatgttacagtaatagactacagtcatcatgcaatgtgttgtcaaatatattaataaacataagaaaaaacatagtaatatactgtgtcaaatttttctatcaagtggaaatttagcacattcttcaggaaatattgactgcaaaatctatgattaatatatttttcagaaatattggatataaatacaaaatgaagtgatgaattattgatatgtgcagttttactatcatataatgttactgataaaattaaaaaaatataactcatttttagcatcagatgaggaaacttggttcactaaagttagtattatctttatttgaatgctacaaccttgaaaaattattacatttgatagaactatttgggaacagtttgttacttctcattgtgactatggacattaatgggatgcccatattccttccattcccttttcttagcatagtggaaatgattacagatatcagttatgtttcttgactgatgttacagtcattccgcattatgaagtatgcaagactaaatttttacaaagggtatctcttatccttatgatagcctaaaaaggtgaaaatttgtcaagcaggtttcctaagatcctataaaattaggggacagggttccagcatcaagatgtagttttacttattgaattaacacagagttttgttgatgattttctttgatgatgggggtagtgatcgtggtattgttttattacattggtttcttcctttttttgttcatttttaatgggaacctcccaataatggtgaggatgcagttaaatggtaactccatacacttagtgtgagtctagaaataaattcaagttttattttgaatacactgaattggtatttctttcattgaataaacatttatctagtgcctcctaagtgccagacaacacaaaacgtaaaataccattggcaaatccatagcaatcatacaaaagacgtgatatttgataaatataactcatacaatgaagaaaaaaaagaacaagaatttatacacagcaatttgacctccgtttgcaacacaacaatataaagtgtaattttctccaatctaaatttgctttgaaaatatggaacaccagctggaagggagctcagatggcttctgcagtggggttggaaatatccttctgagcatgtccagaacaactggttaaaaataattaaatcacttgcaccatctgtgaatcattctgattcttcaatgattacttaagactctcattgtatggaacatattctgagaacagatgaataaaatctattcaagtgtatattgttttccactttgattttcacaaaataaaaggattataatattttcaagttggtaagttatctgataattctcctgccctcctttatgatccagttgcttttgaaataattaaggtttgtttaaaatttagttttatgaataatacaaattcacatagccttgatgttataacataattttgcttaaaaacattctatcatttttaccctttatttaatcttttgagtatagtttagcacccatttagtaacagccaagagaactaaatggaagtccgaattgattgcattctcaaatttagcaccatatgctataatcatgagcagtttttaaaattcctaaatagctattttaacgcatgtaaaacagaggaaagctatatttagtggtgactaatccatggatgaaagatgcatggattaaatataatccaagtgcccatatctgtacaaacttaagatgttcagataatttggaggcattgttaactgtttttctggatatcagtgcatgggcacttctcgccagaataaattaactggggaaagttccagaaggtccataattttccataataattagtgctttcttagttaatagactatctgggtgatgaaaaataaatgaattacctaacaaatacagttatctataacatataactccatctgtgacccgtataaagctcaaaatgtgttaactggttagtatctagacaatcataaacacacatgaaacatgaataatatcggtcactatattttcatttcttgcttcgtagatacactcgagtatttcatatgtggaaaattaagagatctagtcctcttcatatattggcctccctaatgggaaagggtctctttaatctgctacaaagccctcctcttctttaaacttgccaagatgtcttctacctcaggtcattgcaattatgtttcctttgacttgggcctctatttctggatatttccttgctggtctcccgtcacattgcaggatgcagagtgaacattatctccacaggtggcctgccttcgacaacctattttatgtcgttcgccacatccattctatccttaccatcatgctctagaacatcagctagacgtttcccttctaatatttactgcaatctgcaaatgttacctttgcatgtttacttgtttataatttgtctgctatcattagaatgtaggcttgatgaagtcaggagcctattctatcttgttagtcactgtttccccaagacatagagtctatcacagagcaggtatttaatgaaagtatgtggaatgaatgattgaatgaatgaatgtataacatcttcctgtggaaatccctgcagtttcagagttggttgttctgtatttttatgtcagtggtatcctaatgccagtctgccatggtccagaagttttcaatggtccataaggaaaagaaaaaaaagagcaattttttatttagcttttcataaagcaaagttttttaatgcaagaattgtcctttctttcaaaattatgggtttcaacagttttggaggtattaaaatggcctttctttttctttcttctcattttgttacaatgtcctttactagaaaaagtaaagggcagaacttttgtgatgttccctaatagttttttttttttgtaatgttgttattgacctatgaaatacaatgtccgtaaaccaccaacttagataaatttatttacatgaaggaataccattcctgctaagtttctatattggttgcttgaagtttcagaatgaggaagagaaagcatgaaaaccatcacctcctatatgtatggcctgttcggcaagcagtactggccccataacagttatccactggaataacattcttgaatttattttgtcacatgtgaggagcaaaaacaagacaaaatacacaaaaaagagtagaattagggtatcacgacatttgtctaacattgttcaacgttaacacttacaaataataaaggtaccaaaatggtattttcttgtgtataaatattttcatcctctggatttgaatctgtttttgtttgttttggtgatataaagaactcataatagtatcatttcctgatgatatttggaatccaaaaattaattcaaaacagaagtattacattttctgtccttttcataattgtaaacaatgcatcaagatcaaaaacttaacaaaatgcgttaatgttattatgcatgcttttttcacattctttatttcccagtgatcataatgactaataattaacataattatttgtgattgacaaaagactctaacgttcatcattttagttaattattatttaagaaataattggtctggatataatataagccaattaaatttgtattctgaaaagttttgagaagtgaaaaaaaatttattttttatttggtaaaatactttatttctgttgtagctgcttttacaaggagattgtggggaggaacagtcatatccaagttctcagttaattaccttttcaaaatatatgatctaaaatggagtgaaaattgattgtgtcaatatgagtttttagagttaaaacttgtaaattttctggacagaatagaacaattttatattggaatccttgccataggataatacaatgactattatttcctggaacattgacagagaacaagctattttaggagaaactatctggattgtaaagtagagcacattaagcctaaggtgtcattaaattcacaaaacttttaaaaaagaattgagcgtaatctttggtaagagaaaaatggttttcttcagtgactattaccatattttgcaaagttataacctggcaaaatatattattttgggaaaataatattaaatataaccatttctatacacacagtggcactttatttattcagaggtcagatggatatcattttaatttacctgcaacacagccaagagtcaggaatggagtagaacaaaaggcctctcgattcccaaaattgattttttaaggttcatgaaatccaaagcttacttatatttcattatgaaatgaatttccaaatccttttttggagattttttaaaaattttgctttgattaaagaggtaattctaataaacttaattatctctttttttttttgtgcccctagtagctttgaagtcaaaatgggacagaaggaataaatgactgaaacaggagataatagctgcagcctcgagtaaggtgaaaaagaacctatatatatggactcatagtttggggaaataatttagcacagggcaacacagatgagagagggagggatggaggaagggagacagagagagagaacagataattagtgtttatttcattttatacttatggataatttaattatttcaatagtttattcatatagttaggtaaatactttttttttttttttgagacagattctcaccctgtcacccaggctggagtgcagtggcatgatctcggctcactgcaccctctgtctcccaggttcaagtgattctcctgcctcaacctccagagttgctgggattacaggcaaccgccatcacgcctggctaatttttttatttttttagtacagacagggtttcaccatgttgtccaggcttgtcttgaactcctgacctcaaatgatctgcctgcctcggcctcccaaagtgctgggattactggtgtgagccatggcgcccagcccaaggatctttaatatcttacctatgtgcaaaagtgtttaatacataatgccatatggcatattagcttcctaaatcacataccactgccaccagctaacttatatctctatatttacatctgaggctgcataggcacacataaatgtattcatatatgttacacatatgcttatttatgtagctatgctatatgttatttgctatttacatctattaagttacttagcaaaatatgtcctttggctttgaaaaaaatgcctgctgaactcatcaagattatgatttttgtaggttattctccatcttttagtcgagttcctaaagttgtgtttttttaactgcctgctttttattgcaggtatatgaaattgttgtgcatatttcaaagaagaatagaatgcagggtaactctcaaacttgttatttggaattaggtcagataattttgtaaatactgttatcagtatatcacaatgtcattagtgtcccttcaagttaagggcatggaaataaagatggtctaatgtgccaggccaaagaggaaaacttttcagcttagcaaagtgacttcaaatacatggggagaattgaagcagtcatttcaaatgcaaacaaaaagttgtatttttatggattacaatatccttagctaaatgtttactttggcttgggtatttttctcattagtgatacttatttaattagttgcttataaattgaacctgggaagtgtagtttgcagtgagccgagatcaagccactgcactccagcctgggcaacagagcgagactccgtctcaaaaaaaaaaaaaaaaaaaattgagtacttaagatcaattaaaatatatcgagtattggatgctgtcacataagagtgctattagccattggctgttaaatttcctcatctccaggaatctcaggcacctaaaaataattctctttacttcatgggcaacagcagccactagtctttgccacgactcttctgtcaattgggtatgcagtgaggggcaccaatatggttttaggtgatgatgtgaaattgtttcaaaatgctttcattctcccttctgaattttgtcttagtctatgcttccataatattgggagccaattagtagtacatgccttcctgcagcttgaatagaagtgaagtctattatgaacaataaagtcaattagagggggccatgcctactgataaatatgttatgtaaagactcaatttaccttgaaatctgtatctatttgcatctactctttagtgctagttcagagctctgtgcgattattttaaatgtattgcagtattactttaatcaattaatacaaaggtagattaaggaaactttactactcttcatttcttcattctgctgattcctccctcactgaagcaaaaaaaaagtctacaatttagtctttaaaaagtctatagtttagtcttagatatctctttgtactatattccatatactgttcattcttaccaatgaatagtatatatagatatattttacttttttaaaaaatactgctttattctgtgtattattttaaatataacagtcaattagaaacatgttcccaggtaatgtatatagatcttatacattctttgtgaaagtcttagatgatgaatcaaaatgtattctattattcttctacatttctggattattatattttgattagaaaaggtggcctatcaaatctttctttttgatgcttttaaaagtttcctctctatgtaatttttgatgtcccaagtaaataggagaatatgctttttccagtgtgcacaaaatacggattaaatttagcttgtcggttttaaaccacctctattcttgttttttatttgtattttttgtctattttaatctaacaaattacagaagagttgtatgtaaggtaccaactacagctatgattttatcatgttctccttttatttctagtaatttttaccttatgtagaatgcacccaattgtttggggcatagcaattaatgactactgtgctttgggaagaagtgtgatttttgtcattacaatggttctctgagacccatttagtgcttttcggtcttgaactatacttcatttgatgctattattttgactttcactttttaaaaaatggttttctaaatcaccattaacgcagcattgtgaccttgtatttttatgtttcttgtgactttcactttttaaaaaatggttttctaaatcaccattaacgcagcattgtgaccttgtatttttatgtttcttgtaaacagcctatagatggagtgtgcattttaaactagataattttgtctttttaacttatgcaaatatttttacatctttatagggtacatgtaatattttgctacatgcatagaatgtataatgattaagtcaggatagttagggtatccatcatctcaagtatttatcatttatatgtgttggaaatagttcaactcctctcttctaggtattttgagagatacaatatattgttgattatagtcaccctactcttctttcaaacattagcacttactctttctatgcaactgtatgtccgtacccagtaaccaatctctcttcacccattccgcccacctacactcttcccagcctctggtatctataaaaaaaaatcacatattcttaccaatacgtgcttgatcttatgaagatataaaaatgatagatagttcatctttagatgagacattttaaccaacttcatttttacaataactcttataactgtgtctgttttaattccttgtcatattgatggtcattattttatcattttatttactcttatcccttgtctataattttataattcatcatcttcttcactgcactctactgcatctcttcccgcacttataggttatttataagttatactttgtactatcattttactagtgctgtttcccattttaaacaacaattttatgcctatatttctgtagtgttgcgccaaaattaaataagaacaatgccctcatcaccaagatgatttacttagtcaactcctcattattttcaatcaaaggcaaaatcctttaaaaagaaataatttataattttatttcctggctactattgttttcacttgtagtatcacatactagttcaagatgtcatgttattacttaaattacactatcacttcataaaatttgaccacaaacgacacaaggtgtatttcctgtcactgtttttttgtaccgtttatttctcattgttttgaaatctttattacacagtcatccttcagtgtctgtggggcactggtttcagcattttgatatcaaaattcaagaatactcaaattatttatataaaatggcatagtgtttgcatgtaactatggacaccctcctgaacacttcatatcatctctagattatttatagtacccaatacaatgtaaatgctatgtaaatagttgttatgcagtattgtttagggaataatggcaataaaaatgtctgtacatgttcagtgcagacacagccatccatgtatttttgcaaatgtgttcgatcgatgactggttaaatccacaaatgtggaacccatggatacagagggccaactgtacttcagttttaatttggttggaacacatgagaaatgtcctcgtaaaaacataaaggatgtaaactttgtaaaccttgcattttcgaaatgatctttgctttgcagtcatcatgatggatttattggatagtaacattctttaatatctctcctctttttttagtagtctctgtaggttatgaacaattgtcttccagtttccattgttttcttgtttcaactatcttcaagctactattgtttccagtgtaaagtctgattctagtccaagtatcatttatttgtatttaaccttttttctttctctcaaactctaaagttgctgtctgtcccatctattgaagtacagaaatttcattaagatataattttaaatgtttctaaatgtgtccctgtttattattttattttattttattttgtttttatttttgagacagggtcttgctattgcccaagctggagtgccgcgatgcaatcatagctcactgcagccaccaactcctaggctcaggagatcctattgcctcagcctctttagtggctgggactacaggccatcagtaccatgactggctaatttttaaaacatttgtttgtagagatgatgtgtcattatgttgcccaggctggtcttgaactcctggaatcaagtaatcttctcacctcagcctcctaaagtgctgggatttcagttgtgacccaccacttatttaattcttttttgcacttgggtaacgttttaaataaccaattaatattaataacttctttagctctggaaaattttctattatgattgttttaattattacaaatcttccatctcttcttttttctcattctggtacttatcattgcttaataggtatcttagatctgttctctaagtctcttattttttcactattaatgtcagtttatttctatttgtctttaaattgtgatatacttcttctggttgactgtaaagaacccatattttatttttagccatgatcattctcttttctaagttgtctattgttatttaaaaactaggtaacaggctttctgtgctctaatgttaaccttttaatgtttctaattttatttttattaaatgtaccttccgtatcttctagtatactacttgtatggactctcagctttgtctttctctccagccccttgtgtcttctgaaaaagcctttgctttattttctctcatgcctaagtcaaagaatgtaaaatgtcttggcgcaaatgcagttaaggttttgatattttgatgcatagtgattgattgagaagcaacatggatactggaagttttgttgttgttgttgttgttttgatctgatgaataattatttaacaagctgaaacctattcacaaaatttacatatgggaaaacatctctgatctcatggacaaggggtggaagtaaggctgtcctcaaccatgtagtacagccactctccagtaatgcctgcatgaaacaaactagcaggtactgacccccttcttaagtcaaacagatctccttaaatcaatggtctccaacagatcattccacatatatacttgaaaaccatcagatccatcatttctgtctcagatcgtgccaagatacacataactttgaaatatcaccagttcatcatcattctctcttcacctgcaatttttttttccataatttgaggtcctgatacatatattcttctaaattgtagcagttagttgtgattatcttgacgttgcatggactcagttcaaagtgaaacagaaaacatatctacgatgtgatttacccattctcaacatttctattttgtgtgtctgtatttgcacagacacgtacatacatacatgtgcatatatataattaataagctttgaccatataaataatgcaaattatgtataattcacaataataggtttttaaattaattatcttcagagttgagtgagattacttacagatttaggctgtgtctacctgaaaacaaaatacagtgtattagcaattcagtaaaatcaattggatatagaataataacaaattagttgagttttcaccttgtgacattttagtttggatttagtagcctgtctaaattacctttgtgaaaaaactaggctacaagtattttctgatagatataataccagcattagaattattcatataatcttagttttcacattatttaaaatagaacacattgttatattttaataagcaatttgaaaaagaaacaaatctttctttcttgtatgattgccattataaaagaatattaattgagtgctcattaggtaactttaaccacattaagtactagacagccctttggacagagactgagtagaataaaaaacgattacagaacatactttggtattaaccttttctataaataaaatgtattgtcattctctagattagcactgtcctatagaactttctgagatgatggcaatgttctatatctacactgtccaataaagtagctattgaggctactgagaacttaaaacatggctagtaaaaacagatgtactaagtttttaattgtatttgcttttaaataatttagatttacatttctttcgtcaagtgtagctaatgactaccatacgggatagtgtaattatatgcatctttactatcactcgcatttctaatgaagagaatacttccttgaaaaacataattatgacacatgcatatttagacatagatactgagttgccgcattaatctagagatagtgtccacattttctgaggggtgtgacaaatgtaatatagaaataaaagtgtgagtttattctgaaaaatctactcaagttgacagatccacaaggcaacagaagttaaaagcgatataggagggtgaaatataactgcagtatttaaggtctttccatacttattttttcttgtgttacttttattttcacactgaattaagtataagtatgtgtgtgaggtggagggagggttcgatttgcttgtcaacatacaaaaagattgctatagcaagtattcccaagctgaaattttggaatagcttaaaataaaaaatatatactagatatgtaaacgaaaacttttatgagaagagtttgggaagagttatcaaaggttaaaatgattttttgaatacaagtcttctcatacccttcaatttgctaatagacattatgatacccatgaagaagctaaaatcagtatatcttaatatcgtctatatgtcattacctcaaataattgcttatgtttgtattcaagtataatgagtcagattagtaactaaaagacaatttaaggacctaagcacgcatgtacaatagcatgtagctaatgtgctatgaattgaagaaatgcgacatagtgaaatcagatataccttttaaatctatgacaataaagattgcattataaaatgaagaaaatattcctgtttgaattctgaatattcctaaatataaattataaatgtaaatcccagcaattgtaaccacatatctatcttataattatcctgttaagttgatacttgttttttcattaatttatccaacaaatatttttgataacatactgtatgctaggtactaggcatgagtctttgctgcatttattttttgctgccttataagttggctagggtgtataaccttatctattaatttataggttattttttggagatggttttacaaagcaggccatgattgttggtgcttatatattgctgcttatgtgttgatacttatcttggtggcaaccaaagcccttttctttctcttctctcacaggccatacttagtgactaaaattttatcaagttactaatttatgttaattctttgaaaatctgtataaaaatgcaaatgttgtcctttgaaacgaaagactttaaaccactataagccattaacacattttccagattcagtttatcagcttaatttgatagtaattgagcttggccctgaggaattaggtaaatttcatggtgtagaaagtcagaatccacatgaggcaggtcaatgagcaggtctgtccagaccttttacataggacactatttatacctggccttctagaagcagggtgtatttaaagactggcaaatccagcatcatctgcatatctttttcgctgacagcctgccctgctttaaaaattaattctaactttagaaaataaataatatgggcataaaggatgattttctttcatattttaccttgactattttgtgtatgttagtgagttttattctttttaaacaaagggggtaaattgttcattgattctgaataattattctgagatggacaggccctttttttggttacatagcttcacataagcaattttttagatgatgcaataggaagggggaaatcacataagagcaaacactctctcattgctattttttctatgcacggtcataaccaatatgcttagactcattagattgattattcaacatctttctacccagtgacttgactaaaacagacaaaacgaagtactgtcagaatgctgttattgtcatgccattatatgtatccaaaacagtgacaacgcagattaaaaccatacccgtctcacctgcatcatgttgttttgtttttatgctttattgtttggggttttttaatcaccctggaccaatacaatatttttgcctaatttgtttgtgatttgcatttttatgcttacaatgcctattataattgtccaggagaaataaataaaaaatctctcaactttgtttattactgtaatgattcctagaaggaaacttgtctttctctgaagacttgtggggctaagagacagagctacttgtctaagacttaagtctttcccattgccttttcatttatgacccatcagaacctacttaaagcctgcagtcctattttggatttacatatcattgtgttattacttttaaataatccataatatttaagaatgtccctttgaggaaagataatcagatacaaactgacatactttcatattatggctcatagattttcatattatagctcacactaaatcattaataaatcttactttgaggatttgcttattttcatcttcattaacaccaacgcagttaaaaaaaaaaaggctccatcactattttactgtttttggtcaagataatagtctatttttgttacacttttgatgcattgatatatttttcatgtgccatatttatatgagatatatagttattttgtggcatatgtcataatcatatgtcatatagcacatttttcttcttgagtttctttgacctcataactcataaatgggccagtaacctcaatgcatttaaaggagaaagaagtcttttaaatcatggaggaaaacattttgtttaaaaacctagacataatgcaccatttgtttcaaaacaggattgcttttatcctttgcagttatggcccttcaagaaacaaattttatgtaatgaaaagaatgtgataacttaagtttcagatgaatgaaaatgtattcaaaactttgtgagtgatacctgtgcctatttacacagctcagaatcttaaaactgttttgactttaagtttagatcatacaaatcataattgtgttctataatagtcattaagcattgatcgaacttttcatttttaaataaaaataggcattttatggtttctttcacatatctttttgtttctagaaaatgaggctagtatattctttggggtatatatggttaaaaatgaaaataaacacaaagaaataaaatgaattaatcagattatagcatttccttgctaatgatgcatgagtatctataatgatataaggtggtaaagaacattaacaaaagcaagttgattttcaaaaggttagacgggatttgtacacatcagaactcagaaggataaaattattcaaggcagagttaatgaaattcaaatgaaaaggattaatctgaatgagtacctggattttgcataaagaagagaaaatgaacatgatatttctaattacactgatttttaaataactgtctgaaatttttattaaaccaaactgaaagtcattcaatggatgtagttttctcattatagattcgcatgactgtgtcaataggaatgctatacttttaaggaatagatagcaaactagatctccaaatgtctggttctcttttgattcaatttctggtagtttcttgtatatgaaaattacaaaaaagtctatatattaaacattattgtatatatcagattgctataataaatgagaatattcaaacttaataacacggaattttctagaaaatgagttcacagtttcccagtggtgtcaaaaagttattttggaatatttctatttctcaagaaagttcacaggatcaacccttagttttctctagtcagctgatctgtaccacttagtgtctgttatctgtgatgactggacactacgtatcaagatagtaaatctttcaatagatccgtcttcattaaatatatttaaagtataacattaaccttttagactttataacgtatagctgaactgttgcccataggtaattgtaatgagaagcatcttagaaattacaggtattctaatttatctttataatggaaagaaaaatttttgaaagattacttaattatcagtagttgaggatagaaatgatttttctcattcagatttttctaaagtaataaactatacctttttattgattatgttcaaccataagaattttaatatttctaagtgttctagaaaatgtgttcatgccatggctgagcatgtagggattatttccatgtattgacactggttgctctatggcttatttgtgacaatcttgaaaataatcacaatatgcatattattagagcattctcaacctgcagttcaatggctaatatttcttttaagagtatttcgatcaggttaataagagcttcttcattatttaaaagtttgtaaaaaatgatttctagaaccagatacagaattacaattatttgtcacttaggtatctaaaattttcttaaaaattgaactcttgtacagagagtaaaaggatgattaccagaaaaattggcaatttaaatagatgccacataacactcttctaaaagagattttctttgaaagataggtgaaaatggtttttagtttaatgttctgaagaatatttgttaaatcggtatataataatctatggtagacacatggggtcaggtggagagaagcttaacagatgagaagccagggtatggtgtgctgcctacattctttaagccctggtttaggactatgattaacactggatcttatttgctgagacacagaattctggtctgagagcacgaattattattttctaagtgaatctaatttttattttatccagtgtcactgaatgattttttctttttttttttaattatacttaagttctgggatacatgtacagaacgtgcaggtttgttgcataggtatacatgttccgtggtggtttgctgcacccatcaacctgtcatctacattaggtatttctcctaatgctatccctccccttgccccccacccgccaacaggcccctgcggccatatgttttcattgttcaactcccattatcagtgagaacatgcagtgtttggttttctgttcctgtgttagtttgctgagaatgacggtttctagtttcatccatgttcctgcaaaggacacgaactcattcttttttatggctgcatagtgtcccatggtgtatatgtgtcaattttctttatccagtctatcactggtgggcatttgggttggttgcaattctttgctattgtgaacagtgctgcaataaacatacgtgtgcatgtgtctttatagtaggatgatttataatcctttgggtatatatccagtaatgggattgctgggtcaaatggtatttctggttctagatccttgaggaatctgcacactgtcttccacaatggtggaactaatttacactcccaccaacagtgtaaaagagttcctatttctccacatcttctccagcatcagttgtttcctgactttttaatgatcgccattctaactggtgtgagatgctatctcgttgtggttttgacttgcatttctctaatgaccagtgatgatgaggtttttttcttatgtttgttggccgcgtaaatgtcttcttttgcgaagtgtctgttcatatcctttgcccactttctgatggggtcttttttttcttgtaaatttgtttaagttccttatagattctggataatagccctttgtcagatggatagattgcaaaagttttctctcattctgtaggttgcctgttgactctcatgatagggtcttttgctgtgctcttcagtttaattagatcccatttgtcaattttggcttttgttgctgttgcttttggtgttttagtcatgaagtctttgcccatgcctgtatcctgaatggtattgcctaggttttcttctagagtttttatggtttcaggtcttaggtttaagtctttaatccatcatgagttaatttttgtataaggtgtaagaaaggggtctagtttccgttttctgcatatggccagccagttttcccgacaccatttattaaatagggaatcttttccacattgcttgtttttgtcaggtttgtcaaagatcagatggttgtagatgtgtggtgatatttctgaggcctctgttctgttccgttggtctatatatctgttttgctatcagtataatctgttttggttactgtagcattatagtatagtttgaagtcaggtagcgtgatgcctccagctttgttattcttgcttaggattttcttggctatatgggcccttttttggttccatatgaaatgtaaagtagtttgttctaattctgtgaagaaagtcaatggtagcttgatgggagtagcattgaatctataaattactttgggcgctatggccattttcatgttattgattcttcctttccataagcatggaatgtttttccatttgtttgggtcctctcttatttccttgagcagtggtttgtagttctccttgaagaggcccttcacatcccttgcaagttgtattcctaggtattttattctctttgtagcaatttttaatgggagttctctcattatttggctctctgtctgttattggtttataggaatgcttgtgatttttgcacgttgattttgtatcctgagactttgctgaagttgcttatcagcttaaagagtttttgggctgagacgatggggttttctaaatatacaatcatgtcatctgcaaacagagataatttgacttcctctcttcctatttgaatatctttctttctttctcttgcctgattgccctggccaggacttccaatactatgttgaataggagtggtgagagagggcatccttgtcttgtgccagttttcaaagggaatgcttctagcttttgcccattcagtatgatactggctgtgggtttgtcataaatagctcttaatattttgagatttgtcccatcaataactagtttattgagtgtttttaacatgaaagggtgttgaatttatccaagaccttttctgcatctattgagataatcatgtggtttttttggtcattggttctgtttatgtgatgggttacatttattgatttgcgtatgttgaaccagctttgcatcccagggatgaagcctacttgattgtgatggatatgctttttaatgtgctactggatttggtttgccagtattttattgaggattttcttttttgttgtgtctttgccaggttttggtatcaggatgctgctggcctcataaaaagagttagggaagaatttattttcttttgtattgcttggaatagttttagagggaatggtaccagctcctctttgtatctctggtagaattcagctgtgaatccgtctggtcctgggcttttttttttttttttttttttggttcgtaggctattactgcctcaatttcagaacttgttattggtctattcagggattcaacttcttcctggtttagtcttgggagggtgtatgtgtccaggaatttatccattttttctagattttctagtttatttgcgtagaggtgttgatagtattctctgatggtagtttgtatttctgtgggatcggtggtgatatcccctttatcattttttattgtgcctctttgattcttttctcttttcttctttattagtctggctagtggtctatctattttgttaatcttttcaaaagaccagctcctggattcattggcaaatctcatttttatttaacgttcctttctgcaaataccaaaatagtcaaaatttgggtttgaaatttcatttaaggaagttaaatacaagttagcagacaaaagtgagtatattttgagtgtctttttcttcattatatttgaccatacagctaagtttcttgctggctataatccacaattactatatttattaagcaccaatatgaatttaagatagctgagagcatctcaaatgaaagtaatgaagactgagaaaactacatatcaaagaagaatcagaaaatagataaaaacatcttagaattatttttcttttaagaaaaagtgatgaggacatgcatcaaaacttttctgaattcccactgcttttgttaaggccacccagatttttttctaaatattttcaagatatgtccaattctgaaacaactcccttgattaaacaacaaaacaaattaataaataaatgaaaaactacaacttgtcttctacttactctgttcctgataacaaaaacctttgttttccaaaaacttacaggtgtaaaatgtatcattaaaggcagatttaattgcaccattaaataagtattataagaaatacgcttgctttagatgatgtgaagctatctttactgcaggggttatagcaactaacgtgaataagaaagacgagcttattaacttgtaaattttattaagaacaacataatggtcaccaaccaatgtaatgcgtgcaaaacacaagcttgtgttacttgtgctattgattctactgtttaatgtgtcagtgaaaatttcacattcaaatagcctgctgagttatttttcttttaaatgtgtaaaatgcttatgatgaaatagtgaaattaagaatttcttaagaaatctgttaaattctgaattttatttatcaaactctggctcaagtttctaatatccttttaaatgtaaatgagaaatatatatacattattccattgaacatgaaggaatgtgtgccatggatttggcccagatatacacaataaaacaaatgttgtaaaaggtataattatttaatagctaatttgtgcaattctgtgaatttgctatatcacaagtagatgagatatctaaattagaattacttcattttttatatcatgtaagaattgagtatgaaaatcctaggtcagagaaattaaaaacaaaacataaagtgaccagcttgtaaattttactcctctttgtgtggggttcagtctagtatccccaaagtccaatgtattacattactgcaaaaataagtatggtgttgtcataaaaggctgtgcagtaataaatggctacgttagcatgcttatcgtttgtacttccccagagaccctaccactgaaaccctcaggtgacctcatcaacaggcaggtggcagttgatcaattctagacaaagttattgggagaataatttcaattacaagaattttgctgcctatagtgtagacagaagagagcacaggtcatccatctttctgaatttgcctgccaagtagtatttattttttgctcttataaagaatagggaaagatgtattactgggaaactccaaaaggactctggagctggaaattctcatcatgtctagcacttggatcccagtcagaaaagtgtaggtgcaagagaagaggctagtgctcccttatatatcaggacattctggagttctttttaaaatataaattccgcagtcagttctgctcatatagcagcttcattagcagcttaacttagcaagagactagcaacaaaaacaggagctaatgtctagaatttggaggagaagagggcttaatacaaagttacataccagcctaactacttcgtatctgttgtatctcagtgaactttcctatagatacaggaaagttgcctgtgttaggaataaaacagatatgagtccccctcacccaatcccatatctagatttccaggaaaattagaattttaaatgccagttgcaaattagaattagaaatttaaatgccggttgcaaaaatcgtctttttcttaggataaaactactctccttatgacctcatggtctttcgtcttatatttatggtgctaatatgtgtgtgtcacttattatgaaatgcttttaacactttctggaaaaagtaggtatataattaataaatcaccgttttactagacttaccatcgtgaggttttgaatccattttcagcccagtttgtagattcaattgtcagctgtagaatgagacctatataaacttaatggaggaggtttcactgttaggaagctaaaaaaaattgttcttttgtatatctataccagcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaaggtaaaaccaaagcactttcattcgtattttacaaggtgatcatactgatcattcatagtgccagaacaattgacttaaattgtatgcatcatgatggcattttgactttcacatggaattcttaaaaatacttgatagtgtggttggcttcagaaatctagggtagaaagacataagttagaaaatgtattttacaatatttagctttgagagacatcctaaaatgaagaaatgcacaaaaatgatcatttttacatgcagtagggacagaaaggaaccaccagtaaataaactttgatggaagaacagtttattcctagttaatggatgacttctgtttcattttccaaaaagggaaattagatttttcatttatatgtaatgtatattgtttttgttttatattttttatgtatacatattcaatttcaaattaatgtcaatacctgtgctataacatatggaataaaattgaatagaaatcaataaaatattttctttataactgccagttaaaggctaccaacaaaatccagctgttttcaaaccaccaacagcaagttactaaattctcaagtaaggcaaataatgatgatgaaataggctatgaatttcagaaggcagtgtctgaagataaatgaatgtaggatcaagaaaatgcacataataatgtgtctccagataattttcatgatcgtacattttacactcaaaatgaaatattatagtatacccagagcttggtattttcaaatgcaaacagtatgtgattataggcaaaagatgggtttgctatcagcagcacatattagctaaagtattttatactcaaatggtttcctggaagctcattctatatcacacatttgcctgtatgaatatacaaatggataaagctatttgtttgttttggaaatcggtgttgcagtatcttcagtgacttgactttaatatcttaacattatatcaaataagctataaaattacacagtaaaataagagcttcacagatctctggaactattccatccatgtcagtgtggcactgtttcttattctgtttgaagtaaaagtcaaatcacttattggtacaatgaagaaaagaaacctaatcagttaataaaataaagctgacatgccagaattcctgtcattatttctattaactaagttctcatggcagcatagtttgtaagtgcatcattgtcattcaataagtaaattattgccaatgagctaatatccattccttcccaggttcatggacatttggttcaggagagtagtgaccctgatcttattaagttgcccattgaataactctgtctccatacctcttagcctggcatactcagaatgttagacccttggctacactcacagtgaatcatttgttcatcctgatctatttaatattattatagctgatgtcaatcgtaatagtattgattactgcggtttataatatggtattattgtagatttaatttagctaaatggttgaatccccataagatacagttgtgggcatgattccttctgtctcccaacaaatctccagcaggtgaatgggcttcctaccttcattgacttttttgaagggggatagttttgagctcagtcttttcagtgaatatgtatttcctgttaaaggcattcatcattgtcattatccagtagtaaaaatggaaaagcagtgcataaattgtacagctgctggttgggaaggtttgaaattgtggttgattttattcctgacagatatgcatgaatcaaattacagaactatagtaagtattgctgtgctttaacatacatcttttttgaaagtgcagtacaacacaaataatatgtaatatgttaaaagaattactttctaaacaaaatacaactaaaatagcacgtatggtttcaatagatgtattgaattggaaagctacctaatcatgttgacagagactatgcagataaacacaaacatatatatatacgtatatatatatacatatgtggaaatctgcatttaatagcaaaaacactagctaaggcagagctagagaagaatgagaaacatacacataagtaatattttctttcttacttcagagccaatattaacagttaattgattgtgattgcttatatgtacaaagttaataatactcataacagacaagagtacataattttagaagaattgcaattttttggaagtttagagcaatattaacttgcatttcatttttaagaaaaaatcattttcatgataaaattttccaaaatataattactgtgttaaaccgtcaaatcctgccttaaagtatctcatatgaaagcatgaacacagaatttcttagcatcgtaagttttaaattaccaaaaggttttctctggagagagttaaatatttgaaagcttatcctaaaagcagaaatgatccacttaaaagacttaactgaaaggatttatcatcatgtgtccatatgcctaattttactgaaagcatcagttttattggaggatgaaacactcttgggatgtcacccatatcatttcctgactcagcatgccttgtactctgactggtagctgccagatccaagtgtctctgactgtttgccttagggctctctctagtaatcaaagctcatgagtgtcaggtagttaaagttctgcatcccccgtgttccccagcaaacctcaaccaataacaaataacttttggtggataaataccactactcactcattcttcagttagggtaactctgaagcatgatttatgctctgacccaaaattctgttccaggattaagaccccatcgcacacagtaaaaacctgcctcataggatacatttcacttgctccctgtcctaccttacacacactttactagcacctccttggatcattcccaaagacatcccttgtcttcgaatctgcttataggggaactctatctaggacatttttgaaataaataatgacatatttactgtgtagttagcatttacgtagagaaattcttagaaatagttcatgcctttggagtggaattcttcaagtgattctgctgctccctcattcagggaatccttagctgttcaattaggccttggtatcaataaatgtgaatttttaggacaaaaataagaacatagcttataataagaatgacaactatgctttaccttttgcaataatgagaatcaatttacagctaatattattctttatggtagagcagaatgtcttcacctgaagaacatgaacaagacaaggatatctgcccacatcccttcaatattccacattgcactggagtttcaaatcactgaaaggaggaggaaggaagggaggaagtaaggaagaaagagagtgagggaaggagggagggagaattgaagaaaagaaataaaataaggagagaaacaaggaggaaataaatggaaggaaagaaaaaatatcaggcacacatcatttcagttgtctcatcaaaaccaattatagtacagatgccttgtttggaatgaataaaatgtgctatactttgggtaaccaagagggtgatgaaaaacgtggccatatgaagaaagctcacgggtaggagacatggtggtcctaatgtagattttaaataggatcaagaaatagagacaacccttgttcaagttcgagaccacaagggaaagctggtagtgagcttataagccaaagatagtgtgaagccaggtcgttcaagtcctcttgagttcaggttttttgcattgctcttgagaaacaaaaaattgttaggacaagtaaacctaaggaatgtggattcgtatattccaaaaatagttattaagctcttagtatgtaccacacactattctaagtgcttataaaacagtgaaaaagactaacgaatctttgccctcattcagcttttattataacattgggagacagaatagaagcaagcaaacaaagaaaaatgataagtaaatattgcgtattactaggtgatacgtattttgggaaaaaaaaaaaaaccagaatctgttaaggggatataggaccactacaggggtagacgtaggtataattgaaagtggcggaattgccatttcaaatagggtagaaatgacctttgagcaaagattggaagaaggtaagggagtcagccatggagtctgtgtagaggaaatagagtagaggcccaaatgtgggactgagcttatcttaatcaagcaccaacaagaaggccaaagtggctgaagcaaaacaagccagtggaagggtagaaagagatgaggatatgggagttgtgagtgtccagattgtggagggcctttggggccattgtaaagaagattctaaatgagatgagagcaattgtaagtttctgagcagttgagtggcatgatctcaatcatgttttaaaaggatcacactggcttctgggttgagagtagaactgtaggggaccaataatagaatcaacaagagttgaaaaagagatgctggtggcttggacttggtcggtagtgagagaatgtcagattctggaaatattttgaaattagagatagcagatatatttctctggtcatacagaaacttaagcatgtgtctatgaaaacccattctcggccgacttggggctgagttagaactttggtctcgtaaaacctagcagaagatcccttgagagatgtatgatttcttctcatattttagtcttcgattcttcagtcttgccttgaagtagggacaaaagtactggcaacagagatttttaatacactggttaagatctttctcctctggaatctgtttcacagctcttaagcacaaatttaataatcccaattagttaaatgaaggcaaaattatgccatgagcaaagtgactgcttttctattctggtattaggagaattagataatagcaagaggcaccatatgtagaaatccaaacaaaatatctgaaggaaaataaaagaacgattgtttatatgcgtattgtaatacaggggcatattacattgtttatatgcatattgtaatacaggggtatttaataatattggaataagaggacattgcaattactctaaataatcatggatcatataaaatttcaaagcaaaatttgtttgcaaatgctttttgaattcgagttgaattttctaatagtttaatagttctaacagtttaatgcgtggaaaagatgatttttattaatacattgtgactttgtagaaactgatcttttgaactatacataaacatttgcaataatgtgatcagtggtttctcttagaaaaattgagtttttcaacacatttatttggttataaatataatttgtttcttcaacagcttatatgacttgggatttatttgattgatttgctatatataaatgtgtgtattttcaaatattaatcattaactgtagtttaaatcatgcttaaattatttccatagtacattatttttcatttgtattatatgaaaagatttgtactatagagaagagattatagatatttactgcctttcagtcatgcccagctcatatttatatgtgcttcggtacagttttcttttatattttatacaaatctctcttgtaggaaattatccattctttatccccaaccattattttatcaagcctagcagttgtcctaccttgactattatgctgcaatttactcccaactctgctaaaatgtactttaagaacgcactcctactccttccattctcccagcagcactgttttcataatccccatcgtgtaaagtgtagaaagcagaaacttccatattaaaacttacaaatcatgaggctggtagaaattttgaagttgcagttaagttgtggggaggttttccttttattcacaaacggttgaagctgtgcttcgaccagttataatgtcgttttttatgtgtgatatataattactgattcgttatttatgcaaagacaatgcatcatcctatgaagaatattttggtccaaatacgtagctgtgtttagaaagtgttttctcacatggggacaataaaccatgaagaaaaaattaaaaggtcaccttaccatagagccaccaaaaataactttttaactttttttggaagctccgtaaaacctagttaataagtactttaatgccttttgattgaacacagttcccaattcgatatgtcattaatgtagtgcctggtagctggatgggatgtgaagagtgtaagaattagatttatatagggtgttgcctttatctgtcagataaagacaaattccagagagtgaaaatgaactggagtttgagtctttggttctcttatttctctttttccattttaagatagatctactccccaacggccgctgtcacaacagttactaatgggtttttctaatccttttttcttagaaatgaaagttatgtgctcctctgttaaccaagttacaaagtgtctcaaggcatttctgatacctaaaactgcttaaagctattattttcaccttcccaaaatatgacgacaatagtgcctagagttttataagtctataaacactatacatgcatttaagtatatgtataacccatgtaactgcagtgctacatttttcaagaaggtgatacatacacacagccaccaggaagaaaaattagtatcttgtttgttgtttttttcctccaccactgtatctagaactcctagaacagcacctagcacttaaaggtactgaatgtacatctgttgaattagtgagtgatggtctgatacatgtaggtgtggactctgagatagaagaagacagggcagtgttagtaagcgctggtactaaaagagaaaaccaaatttacttctttttatattgtatcctaactcactgagttaaatcatctagacatgtgcattctacaaatctatatgcatataagcatgaagaaattgttctaggtttgtatatactgaatctaaaacaatcatttatgaaaatgtgtgacagggaacccacatataattaaaacattactaacatttttccacatcagtgagctttcattatgtggttatgataagcagtagagtagagagtttagcaaagtactgtattggaacctgaaaagcttagaaagatttaacctgattgttgatagttgtacccttgggcaagtaacataagatatttaggcctgttttttaacgttgaaattaaatcagtgataataactgcccctgcctactcaactgtactcttgtgaagatacagtgaaatcatgtacgactgtgtaggaaaattcctgttaaaatgtataattatataaatttcaagatttgtaaaatgcatattgcttcatcaaacatcccaaattctaagaaagttataaatttccacgtaaagtatcctaaaaacaaattacctttaagaatgtgttaaacattataaaattgcatatttatatcttaaaaaactgtaaataaaatgttaaccacataaaatatacgtaaagttatttccagatgtggcaaatattctaaagctaaaaaaactttaaaataagagaatacatacaagctaagccacgtttgcttttgacaaaatcttccttagaggatcttacaaacttttgatcatattcttctattgtacagaatgttccttgacttgtgatggggttatatccagataaacccattgtaagttgagaattttgtatgcggaaatgcattcaatacacttaacccaccaaatatcatggtttagcctagcttaccttaaacatgctctgaacacctatgttaacctacagttgcgcaaagtcatagaacacaagacctattttatagtaaagtgttgaatatctcattcaatttagtgaatactatactgaagtatggtttcgaatgaatgtatatcactttctcaccaccctaaagttgaaaaatcactaagtagaaacattataagacgggggccatgtgtatttccgaggctagttgttacttattcaggagtaatttttttattcttctatttatttaaggtataaaacaaataactcactttattgtatatttatcttgaggtgcagaaatgcaactctaaattattccaagattctgtgtaccataacttttaccaagaagaggatgctgttttctagcttggttttaattgttgttttattttgggctttagtttctttatgaaatgtgttgatttattttttccatttctagttcagtaacttaaaacccattgttctaattgtgagttcagaaccatgacaaaaattattgaaaaatattgaaactctaagcaaagaatgatttaatcagtagtgtttttttctcttttttgctttggagtcttgaaatttgcttttgttgtttattttttgttgtctttcctttgccatttaaaaaagttagtttgtatttattttctcctggttaaatttgtaaccatgaacatattaaaattataatgctattccattgaaccttatgaattgtcaagtctttcaaaaggtttaaatattggcaatatcttatagtttaatacaatgacttgtacccaagtctgcttatttctgaatattaatatatatcattaaacatcctgatggaaaaaaaacaagaactttctgttgtaaatcacgtatgattaacagacaccaattcccaaatttaatttgccaaaccacaggcaaaaattaaatagtgttatcagtaaggaaatctatggagcttccaaaaaggtaaacattgagtagagtgttagcttcctgctcccatatcatgccttttgtttatttcttttctttcttttttttttttttttagatgtatgcatttgggtacagaacaattgtatgaaagagcgattttgcttttctgtcccctgtgtaaaacaatatgatggaaagcacatttccccaacatcagaagtattagttatatataaaacgggcataatattaccaaatatgttttctgttttaccaaaatagtttactgtcatcaatattaatttttgcaggtttgattatattttatcatgtatggtagctacctatgaagttgcttaatcatttatactaaattttcatttatcaaaataataagatgctcatgattgcatatgtaaatagaattaaaaagtataacatgaattttaaaaaagcatattccattcattggtgatcatcagtttttgaggttttcttggattgttgtattgctttggaatttttcctccataaaacctacctggccctcctctgctgagtcacacaacactaaagcgtatcctgactctaagaaatttgggatcatagaatgccatatattttgaactaagagaaaagtacttacttctataaaaccccctttgccatgcatgtgagtcaatttttctatttggattttctgtaaaatgatttaggcgatgtgtacaacttaacacaaaatgtacgtatcataaaaggactggtaaaattgttttcaatttacttagtgctgatggactagaatcattttatctgagaaacacttggatcagtaaagtgcagggttttttttgttgttctttttgttcttgttgatgctctgtggcatctggagaaatgggcaggtgtaattctgaataaaggacttttttcttagatatctaatgtgctgtgaggaaaccataaggaaactcagccaggaaatgcatgtggacttctattccactgttcaacagctaatgtcttgtaaaagtaaagtagaataaacaaggaattacctgaatagctcacgtctgaccatacctgaatatctatctacaatggttgaacagagtaacaaatcttagaggttcaatgattgaattcaaattggattttcataagcaagttcaactcaactttttacttcaagtcaacagatatttattaatgctacaagtgctatgcttaacattctaaaagataagaaagaaatattaaggaataatccttgtactctggtagttgataacattattgaatatacatattatagttatacaaacaagttagagagtaataaagacattaaggacatcatccaagcaaaaatatataagacatgagtgtaactgaaatcatgaaaagaagaaagcagcacaaaaagcagaaactaggaggaattttatagaggaggaatccttagcttgaggtgtgaatataactggaatctggactaatcttgaatgtaatagctgacagttattatttttgtgccaggacacattctaaacacttagagtaacttgtatggtcatcataacagccctacaaggaaggctgtattattatacccatactcagatggagaaacggaggtcctgagcagttaagtgacttgctcaggtgagatcatttttaaatatcatagttgaagtcccactctggatgttcaagctccagagtttctgctcttaagcactacgctatacagtttcttgatgcagaaaatgttttcaaagttaaagatacaaagtcagtaagggtaaaaaaaaaaaaaattgtatcagaaggatgtgtctgaagaataacaaagagattaatccttcactttgttattcactttgattatcctttcaagtgtctctgctggcaaagcactaggaaatcaagttggataaaaactgtgaatccagttttttcttttttttcctggaaaaaaagatgggctaaaagatgggcttgaaagtgtccaaaaagctatatgtcatcatggatggattttggtcagggataatccttaaaatggcaggataaattggacacaaggaaaaataaagagataaaacaataagtaaggagatatttgtgttcagcatagctggaccgatttataaaccatacccttgattcagtagctgtaccaggactctcattattaaagttcactcaggagatgcccaacatcctagatcacccattttcctgtgttagtgcaaaatgtggactggatttcccgatacatatttctatctagttaaataaatactctgattggttaaggaaaggttttctggaaggtgtatataatcccaccatggcaacagaaccaagagtctctgactgtctaccaacctgtagacttgaattttttccctgtactttcttctagcttcttcgatttctgttatccccaaaacaccttgatgtagccttaagcagaatcaaccatcaaagggctaactccctcctcctgctgggtgccttctctgttgggccccagcagcagtgaatctatgctcccaacttgacatttttcttatcccctttcccacctcccctaaataaaattcctttgtgtcaaagtttgatttaagtgatagaaatggctaagattgtctacagggttgggtttggaagaaaagaggtctggaaagggaatatagcaaaacatcagtattttctgagcaagtttggaagagattaaaaattacccctagtgactctcaaatttatatctctagtcaagattcctctcctgaatcatgacatatatatatatgccttttatatattcacttagaagtataataaacatcttaaatttagcatgttaaaatcttacaccctaaccttatcctcctgcagttttctacactatagttaatggcaactccattattccacttgtctgtgccaaaattcttcatgttatccttaaggcctttctctaccaacacacatgtaattggccaccaaatcctaaggattctgcctttacaatgtatccggaattcaaccctgcctccactctgatccaaagcaccatcatctccagcatggatgattgcagttgtctattaacaagtttccccctcattgccttctcccctgtagactctactgtcaatatactagccagagatacctatttaaatggaaagtcagattatatccccctttctgcttctgttcaaaacccccaatgctccccatccccctcaaagtaaacagggaagtccttatgttcataagtaccttcatgggttacccaccccattctctgatatttctctggtagtcgctagctcatacactccagccataatcacttcctccatgttccttggccactcctccaggcacattccagtgtcagggcccttatacttgctttacctgtctggaatattattctcatgatttttctttcaatggttaatttctgcatttccttcagatctttacttaaaaactgccttcctggtaaggtcttccccgacccctcttacctaaaattctgacccccactttatccttcatttcttccttccctgctttagttttgctcctcagcacttaaccactatctaactgagtatatagtttagtcatttctctatttgtttactttattctcctgtagaaggtgagattccagagagcggggcttttgctttctggatcactagtatatacccaagatataatatatgactgtctcaggctgggcgcggtggctcacgcctgtaatcccagcactttgggaggccaaggcgggtgaccacagggtcaggagttcaataccagcctggccaacgtaatggaacccgatctctactaaaaatacaaaaaattagccgggcatggtggcgggcgcctgtaatcccagctactcgggaggctgaggcaggagaattgcttgaacctgggaggtggaggttgcagtgaacagagattgcgccactgcattccagcctgggtgacagagtgagactctgtctccaaaataaataaataaataataaataaataaataaataaataaataaataaataaaatatgactgtctcatggtaggttttttcaacaaatatttcttgagttaatgaatgaatacagcgatgtagctgtcagacacagagagagaaacctagaagatagtattactagttaaaactagtgtggctaggtctgtatgatgaaaactgtgcctaactgtactgaatcctgccaaggagggaaagatgaaatggggaagctattactaagtgagtgaataggaatttccttcaggaaataaatatggttaaaaatgtgaattataagtgcttccagctgtctgctaatgttagtccttcagagaaatgaaaactgagaaaccattagaaagcaattttatcacttcttttaaaaaataaagttcaatatatttcaaaccagaatatcatcgaaatactgaagtcattttcaggggaaaatgccctgaaacaacaatttcatattatcttatattttaacttatgcttttatacatttgaaattttatttcatttgaagacttttttctaattgaaatttttgactgagagaacactcacaacttctgatgtaaaattttattactgaggaaaaactgttaaacagaagacaaattagccaattaatgtttgtatatacatcccacagtggacatattatttaaaatcttggaaagagttgtagatttgtgaaggtatatgtgagcttatttctaggtatgaaataagggagcaaagacacttgtaaattatagacatccttatttagtaattggatgttgaagatgaagaaatggctgaattgaatgaccacagagacgggacagaggaagtgatgtttgtttgtttgtttaattgtttattgagacagagtttcactcttgttgcccaggctggagtgcggtggcacagtctcggctcactgcaacctccgcttcctggggtcaagtgattctcctaccttagcctcccaagtagctgggattacaggcgcccaccgccacacctggtgaatgtttgtatttttagtagagacagggtttcacatgttggtcaggctggtctcgaactcctgtcctaaagtgatccacctacctcggcctcccaaagtgctgggattacaggcgtgagccaccgcgcccggctgctattttaaataatagaactttggcacttttcacagtattcgggaagcaacgagctttgctataggtacaaaaatatatttaaaacttcagtaaattattttaagtttactttcatcaaaagtgattaacagtaagttcaatttgtcagatattactctcccctactctagttctcttcaggttctgcaatatctactttgacatttatacacataagtttaccatttagatggtaaaggcaggctctgcaatgaaaatctttgacagcaagggagtagttgtcactttacattaaatggaagaaaaactaaacagtagaagtctatcccttatgataaagaatggagcatagttaagggttgcttcatacctttatcttaaactgattagttggcaaataggtcccttgtttgtttcctagataaattttctgtattctctggcttctccttttatcctgttaaagacacatactccacaacacttgaataaacaaagcatttttatgttcaaattatttctgtatgtgtctcctttaaaaaccaattatcttcttaagggagagactcacattttaaagtctttattttcatatctcacatttgaggctgatattatgtctgtattatcaataaacacttatttaaacaataagcttttcaaacagataaatgaattgaagccacatggcttatagatttctgcttttccttactttaggtatctggatttcatctgccggttgtaaaagttactgtgctatctaatttttctctattcacagtgcataatcagggtcttctttaacttattggagactgtgaatcagagatgcaaatatcctattttaaaatattaaggactcgagttgtataaattcgtgtacagatgcctttcagaaattaaaattccatttgtatgtatatttagaatttccttttgcagaaagagtggccaaaaataaacatcttacagaatttcagcggaatagtgaagtggtcaattcataggggcatgtcaaaattaagaagggatttgactaaaaagttggtactttatcattttgacatcatattttcagataagataaggaactattcagggagagaaatagaaatgctatattctatagtgattctagggatgtttatatcgccatagcaactacaagggactatggcttcctttttagagggtcagaaactataaagatcacttatttctagacaaactaaaatagtaaaatactatcagagatctcatctctgactttaaactatggaaagtgctacagcattttctttggtgcacataccatttttctgtgtgcagtgccttgaggacacgaatatgtgcagggactttaaaaaggatgtatttcctggactccagccaattttgacagcattctctgagaatgcaccaaggagctattatctagatatccagggagtgtgacatcccctgccccagtttttgctttttgcttttctcctttaagatagaaagttttcccgcgttagtaacatgctgtacagcattgctaaaaccgttcataacttgatgctgagcaatgctacagcattccaaagaattggtagctccccagagactcagattaaaatcaggaagctttgcaagctcaaatcctcagagagtatacatacacacacatacgcacaaacacacgcataccatatcaaagccataactggataacttttatatgctgatggggaagatcctttatctcttcccttgaatgtttttctccatgggtgcttacagctatgcatttaaagggtttgggcctgctatgtactaacaaatgtgattggttgcccaatgtgaatttaagtaatcagcctttcattcagctggagtcttggtatcaggtggaggacttggcagagttatgtatctttgccattggactggcagccaagcaagaatgatggagacagtgacttaaaagaattcagagttgaatcaagtacttgtgaaatcaggctgcccaggtcaggcaagttaacagaagcagccaagaagatatgttggtgcacgtttctggtacctgacctaatcaggctagcggagtagccctaaacattccacccaagactccaggcttggagccatcagaagatggtagtaaaattctaccaggtaaataaaagtaaagaaataatactagagatacgcttgagttcaatggcttttagggcattaataacaggtattacatccattgtatctcttttattataatttcaagtgtattttagattcaggaatacatgtgcaggtttgttacatggatatattgtttgatgctgagatttgggatatgaatgaccccatcacccaggcagtgagcatagtatccaacagtttctgttttattatgagttttgtttttatcaatatgaaacttttcttcaataagcaagcctctgatgtcaaatacagcatactgcaatgtcgtacaaagctattttctattttatagtgaaagatgatgacagcaaaagacagtctggtctgcctacatttatgttttccacttccaacatgctgttgttgctctcgataagatcaccaatgacctcctaaattgcccgagctgacttttccctcctggtcctggctgcatctgacttgttgacaactccctccctccttctggttctcttcctgggtctgatgactattattctttagggatactcatctccttcctctgcccatgctttccacataggttcatctttatgctacctttcttctcactcttttcaccctaaacacctttcctgagcaatctgaccatccctagtcttattcaacatcacacacattccaatgactatcaattctctatgtgaaattgctaaaagacagttttaacctgcattcctccagataagtaaattctcagattgtttctgtgttggcttgttctttcttttgtatggtaatacctgacctgtcagataagtactttttccacagagttaaattgaggtgcgaaacaaaagaaataatgaaagctttccatcacaaggtgtacatagactggaagagaatgccttgaaattttattttaaaaacaccttctttctctgaaattcactcacatcacccataaccattgtatcttatcctgttgctgagctgataaataagacacgagaacacagttgctttttataaggttcccattgtaagcattgacttttaccttttacaactgacattatctgtagtctcacctgcctcttcagcttagttcttgctcaaggcaagtcctcgtggaccacaaacgtgaaatcttagaataaggcagaaaatcctctaagttttattgttaacttctttcctgtttccctctctgattgtgaagttttcttcagagcccgtcatctggaaagctgtacgatcagcagcagtcactccctatctaacacagtctccaacttacaaatgattaaaatgcttcccaattttgactgaaaataggcaagaatattccctttgttttgggaggctgaggcgggtggatcacgaggtcaggagatcgagaccatcctggctaacacggtgaaaccccgtctctactaaagatacaaaaaattagccaggcgtggtggtgggcgcctatagtcccagctactcgggaggaggctgaggcaagagaatggtgtaagtaaacccgggaggcggagcttgcagtgagcctagatcagaccactgcactccagcctgggtgacagagctagactccatctcaaaaaaaaaaaaaaaagaatattccctttgttgatatttgttaaaatttatatttatctagtcaggaaacataagatctctggatgagagaatacatcattaattactcaaaagcatctcagggcaagatgtttatctgtgagtgcaggggttgtagtacaggagagaaatcccagaattgtggatcttggagattatatagagcacctgatgtatcaggaggagagaaagtgagagagacagacatacaggaagacagagactttgctctgggctataaaccaatgatctaggtctattatttttggaatataagttgaaatgtaatcaaagggctcttggagataaaagtttttaaatctctccagagcaatgcactaaactccaaggtacgcttgccattcagtcaccctttaagacagttactacaactctttgctcagaaagcctagtccatgtatccaaatgtgaaaatatgtatggctcagcaatccctgccatcttactcctcttctcaaaatctgatttcaactgcctctggaacatctacagtttgatgcctcaaaggcttttcagaatgaccatgtccaaaattgaactgatcacttatgcacacatacacaagcatgtaaccatggaacctcttcatctgtctgaaatcctgttacccaatgacaccacaaatcatgtggatgcccaggccagatacctaagactcattcaagttcttcctcttcttcacccaacacacagtcactgaattctgctgagctgttttcctaaacttccttcccacttcagctcaaatgtgaatagcaactagatacttgattcaattaatgaacttttgttaagactgtaggtgtgttaatggtattatatatgtactttccgaaaaaagttctcatgagagaatatttcagcaagagaaaaatgctgaagtatttatggagaaaataatatatcagtttgtttcagaataatctagttgaagaggtgagtgggtggattgtccatggagtcataacagttggcactggattatagggttatgggagctatttgtattattttcctactttcaaatatatttgaaatcttacataatgataactttttaaaaatcatagttccccattagctactgaagtacaggcagaattttctgttgagattcaaagcacattattgaacatcctcagcctctgtttcatgccccatcttcccctaagcttctatgttactgaaaaggcagccaaatatgactgcgcttgttacctagctttgcgtgtgtgttacctactagctctaatgttcttcccacttctactactcagatatgtctactgcaatttgcaccttcttcgtgaattctttcctgagcctatgaccaaatatatgatacatgttttctctaacttctagaaaatgtttggtaccacttggaacactcatttcttccttcttctcatccagctaaggcttctatacttggatttttttcttcaattcttcaaaccatatcctttcttactactacaataaaacctacttaaaacttcttaaaggcaaactaaactgtgtttcacccacctttgtttctgctatattgctccttacacatgggaagaactcaataaattttgctcagtggaccttatgtataatttagatgatcaaaataacaaaattcgtactaggaagaatagccagaatgtagtttttagcaaatttattgagaataaatatgtttagatttttctttcttcccgtataacccatttgtggtttgtgatttttccgttaaatagaatataaacaaaacattatggattaaatttatgggaccatctattcatttattcaacaaaaaagcttttgccatctatcatgtgccaagcacaggtttgagctttggaagcccaacagataacaacatccctgtagtcatagatttcaaattagtggtatataccggctacttgatatatattttaatgttagtaataagtactataaagaaaagggaagagtaatgccaggaataaagagtgattgctggtgctatttaaaatagagtagtagagaaggcccctttaacgtgagaaagaagtaagggaaccactgatagaaatgtgggttaggaaaactatttttggcaggtagaacagcaagggcagaaatcttgaagcaagaatgtagttgttatactcaagtaatgcaataaacctaatgagggtgaagtgttgtggactatgaagagactgggaagagatgagcttggaatggtaggtagtatacaaccaagtcatgtagagatttataggtcatagtgaagattatgcttttttaaaaaaagtaaaagcaagtttattaagaaagtaaaggaataaagaatggccactccgtaggcagtgcagtggcatgggctgcttgactcaggatacttgtagttatttcttgattatatgctaaacaaggggtggattattcatgagttttctgggaaaaggagtcagcaattcctagaactgagggtttctcccattttagaccatattgggtaacttcttgacattgccatgcatttgtaacctgtcatggcactgctaggagtgtcttttagcctgctaatgcattataattagtgtataatgagcagtgagaaggaccagaggtcacttttttcaccagcttggttttggtgggttttgactagcttatttacagcaacctgctttatcagcaaggtctttgtgacccgtatcttgttctggcctcttatctcatcctgtgactaagaatgcccaacctcctgggaatgcagcccagtaggtctcagccttattttacccagcccctattcaagatggagttgttctagttcgaacgcctctgacatatttcccctctttcttttacaagggaacccttaatcctaagggtagtagagttacccttaggattaagtagtagaagggtaatacatcttctgtaacttcttcaggctgaatatgggtgatgatatttctgcctaactattagggtctcttgtattcagggtagagaggagctcagtcagcaagcatcagcttggtgagggccattcataactgataaatggtgatatctggaagattagtaagttttcaatctaagaaaacattgagtaagcttattctgcattcctatacaaaaagtaaaacagcaaatatattccacaacagtaaaacacaataagtaaaattatcccaagtaaactaaattagaaggctttccgtgaactgggcagctgttggaaccaaagtgatgtggggctgctagctgattccaatacatgcccagaattagaatactgatccaggtttttatattacccatccttcttgtttcttctgaggtgcagtcagagatcactggcaggttcacaggaataagcaggatcagtctatattgcaggaaaaaactcaaaaacagctgacgagactaataacaggtgtaccatagttcttaaaacataatttttttctctctccagtctcccatttttactaaagatggatcatcataggactgatttgctttattatacttggcctgattatttgtataaagtgttgcaagaataattatttttcatgtaggcttttgaaattggctgtgattgaactctgtgatgaagagccaccagaagattttgagcagaggagtgatatgatcccaattatgttttaaaagaatcttttcggctcttgtgtggagaattatccagtaggggggaaagagcggaagcaagaggaccatttagataggtagttctataacccagatgagagacaataatagcttctatcagatctgtagcaagaaaggtagtgagaagcagtcaaattctgcatatgtcctgaaagtcaagccaaaacatttgcccaataatttgaatactggagactgaaaaaattaaggatggctccaaagttgtcaatctgagtaattgttaattgaattactataattcaattgaaatcagtaattgccatttactgaaatgagggaatctatgggatgagaaggattaggaaatgcagttcagaattttgtttgcgtcatattaagtttgaaagtctcgtgagacctccaagtgttgagaaattagcatttgttagactggagttcggaggagatgtccgggcttgagatacacatttgggtgtcattgtcttatataagatatttaaaattatgagaacaaatgggatggattatggacagagaagaaaagaagtgcaaatactgagtcagagcactctaatattaagatcaggatgagaaggatccagcaaaggaaagcagaagaggtcaggatacagaagccaaatgaaggcagttttaagatgtagggagcgatccactctctcaggatgaggtctgtgatttacctattgaatttgaacatgtcaaagtcactggacttcatggttattaactttaaaaagtcaataattaagaattgcaacaccatttgctacctttgggatttgtatatatatatatatttttctctttctatagacagctaattcatttttttactgttttaaaatttttatattacagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggtaggtaacacatatatttttcttgatacttgcagaaatgatttgttttcagggaactgtagaatttatttcagtaccctccatggaaaaaagacagggaaaaagaagtatcactctcattgaaaaatggtaagtaaaatgagaacaaataatgatgaacaattcagacaaatgagctgaactgtagaaattattcagtattaaatttagcgttatgttgaagcattatatcttctaaaatttcaggtaatcgtaaatcagattggggcattgaggtgctataaacagttgttcgatataacatatttatctttagtcaaatctgtatctacaaatttataggagtttgatacttagattaacatgtttaaaatactacctatcaataaaaaaattgattttcatttatttatattttggagggtgacactttacactttgcattaccctcccccacatttttttttgccatggggaatttgttaagttgatttaaaatcatgtttctttttatcttaattgaaatatttagctgttgacttaattggggggtggcagaaattcaattacattatttagcttcacatcacaagaagtggattactctttcttttacatttttagattaaaagtaataaagttctctaacagcttaaagtgattcatttcagaagtctttatcctcaaggtaggcttcttaattattctcagaggaaatcaaatcattcgtctaataattatagggaacctccatggtatctcttacatctgtccatttctaaccatctttactcctattttagttcttggtttactacatcaggcacctaaagagagatttctagcattaatctcagttgtctcaagtgattatctccactttgttctcaacgatctttcagtggccgtcatttttctaaagtgtaagagctttggtactataatctcattcccttgagaatgaaaccctgactccttaattgtgcaaaattatctggtcagcctcactgcttatttcttcgtgcctgccctatagcaagcccctccaattatgttctagcgatattaaatcaatttgcagatgcccaagtgttttgtactccctctgacctgcctgttcttcaggtctcacttcagatgttgtctttttctagaaatcctaaaactattagtcgctcctaacatctggaaacttggatattgtttcatcatttaatgtaatttaatatcaataaatcatttatgcatttgtaaattttccagacttggtggctaccgtgtagaatatatgatctgatgtgcctgctcctaaaacctaacacatagtaatcaatttgtttacttttctgcctcccacacaagctccttatagaaaagggctatgttttatttgtgttatatgctcaggactgatatagtgctgagcacaaagtgggtgttcaatgtgtctggactcaagcctcctctccgaaacctgagaatatttcccctttggatagtctaccagatttatctcactgcaccttccagggcaggtgcggtggctcatgtctgtaatcccagcactttgggagtccaaggcgggcacatcatttgaggtcaggagtccgagaccagcctggccaacatggtgaaaccttgtctccattaaaaatacaaaaatgacctgtgcgtggtggcatgcgcttgtagtcccagctactcgggaggctgaggcaggagaatcccttgaacccaggaggcagaggctgcagtgagcccaaatccaccactgcattccagcctgggtgacagagcaaggctccgtctcaaacaaaacaaaacaaaacaaaaaaacagatttatctcaacttccttgaaaatagctggtcccacagtatccaaagccaggcttgataaaggcaaagaaactcagccactctgtgtatatgctacaaatacaaacttaaacttataaaatggtggctcatgcctgtaatccctgtgctttgggaggctgaggcaggagggtcacttgagcccaggaattcaaggctgccacgagccatgattgtgccactgtactacagcctgagtaacagactctctctaaaataaattaacaaaaatatttgaataaacttatatcgccaccatggtgtactttctcccagcatttcacattgagacattatgaggctctgcgggctactccaatgatgtcagtttcattaccatcttttgggatgttcattccactcttgggaagttcttccccctctggtttgtcttcttatagtcagtgttttctccaagcattctaggccacccacaccatcccctaaggaccgttgaggtttcttggatagccagtgattactgtgcttctatatacacctaccagttttgcactaaagtagaaataacgctttctgctttttgaggtttctcctccgctttactcatgagtaatttttggcaaatgatccaggtattcccttctcactgggtcatatggacatttccctttcagtttaccttcaccttagacttaaacagaaacactaacgccattccacagagagggtcgctgaaatctcaccccaactctgaggacttttctggttttgacaaaggatagagtttctctagccccaatagatccaccctgtccttatccagaggttgaaattgtacttccattgacattctataggaattggtcaggagctgttaaatttcctatgacttttagtacaatctcagatacaaactgttttaagtaattgcttataagcacaggctctagagttccaacccgttttggaattctggcctttctgctatctatgtgcccttgagcaagtctcttaaatcttctgctccatacatttctgatgtataaaataggataagaatagtgtctatgtcacagggttgttatgaggattatctgacacaatatatgtggggagcttagtgggttgcttaaacacgataatggctcagttaaggttggcaattttgatgatgaaaatggtgatcttatggttctgatagtcatgatatctgttaattcattcttacatgctttcaaatttccctgagaactacagagagaagaattagactcagtccctgctttgaagagcttcacagtcttggagagaaaaggcacaaccagccagtaaaataagggttgatagactggagctgtacaagagggcaagaacaagatccctggggaatggaatgaagctatcttactaagaatggggaataagtcaaggtctatagaccattcaaggttctgagttacaactaacagaaagtgactctagttactttaggtagaattatataaattactagaaggatatcagatacctcatggaatcaataggaaagcctgagagctaggtttaacaatgggcagaaactataaaggaagagcaggctaggcatccagaatatatctactatcaagctatgaggtaaatctgaattattttgctgtcatgccagagtccattgctttaccaggagcaccattgcactggacattgcttgctatcgtcactgcaaaaaaaaagtatctaaattatttattcttgctgtgtgtcgctcattctacaactagggtctctggcagaagcatctgatagtcagaggatggatatttttttctgtaaaggggcagttagtcgatatttttgtccctgcaggtcatgtagtctctgtcacaactactcaactctgctgttttagggtgaaaaaaaccatgtataatatataaatggatggacatgttgtgtttaaataaaactttatttaccaaggcagatggcaggctggaattgctgatgggccatagattgatgactgctgttacaatacaggtttaggccacagaactaggttcttattgccagagatcagggaaaataaatagctgaatttgttcttcattgtagtggcagtcaacacctcgtgtcctactaagtcccatacaatggtagattcttgaatccttggagagatttagaagctatgcattcctgaatacacaaatgttcagtacagccttcatgtggtgttctcaacaaaaatctgctgagttttttagtaagccaatttgggttaaatcaaaataaatttgagctagtaagaagggctatattggtatttttcttaaatggtacatgtatggtagtattagctatgaccgcaataatgctgtgacacaaatcaccctagaacttgctgactgaaaacaacaggcatttctggctgtttaggttacttgtaccttgactgactcagctgggcttggccgggaagctctgcttcaagatgtgggttagtagagctaggttccatgatgcatgttggattaaggtctgctatatatgtctttgctctggacctaagatgaagggtcagtgacatgttttcatgaccagtcaccaaagtataaacctaaacctcccaagaacactcatggcctctgctcctgtgaagttcactgacatttgattggccaaagcaaattacgttgccaaatctgacatcaatagaatgagaaagtagactcttcctacagtggaaggggggagagatgttaatatttgctgaaccataattcaaattattagagatagttaataatttataacaggattgttttacagctagaaaatgccttagtggttttgccctgcttcattattttataagggagaaaactatatttcaaagatgttatgtgacttgcctaagcacatactaaatagtacatctgcgtatttctcgttcagtcatctctattaaatgtcataaggtaaaacagacattacgctttagatgagaacaggaagatatttaaaaagccagactaatttatgactgctcattcattatctaacatacctgcttccatacattgtctttcagcaaatagaatttcaacatgtatctcaacaagttacacatcatcaaagtattaaaagccttattttcacggacattctgattgttcactaacagtcaacacagtcaacagtaaatccacaagcaccatgaacgtatggatagatatgcctatatgtaagattactagttaactttttgggaaattaatattactgctaaattcagttttcattgattttcgggtgggtaactaactgcttataaaatatacctataggaaacatgtaaaaacaaagaatttacataagatctatctgggattagagaaacaaagctcttttcttctttcaatgaacacttaagaagggcctactaaatgtcagatgttatactctattgtcgttagtttctttctgataccatctttactatcctgtaagccattagtgagtgtttcccacttttagaaaatgacttcccaaagactaagagggtagaacagttcaaatgctatcatcaaaatgaaggcagtttctagactacaaattgctgtacagccataagatggcattattgtgtaacaacaaggtccctgtcaaacatcaagaaagtaatgttttaaaatcagtatttccttcttggaattctacttagtcagatatgttgggttgacttacccacccatataagtagttaaattcaagatggttctgagctttagatatgatgtaaaatagacatgagactaagagtatttatttctatattattacatttctatagcaaaaaaagaaacctctaaaaaaattagagaaagaagtataagggcatttaattaatcaaatgttcttattaataatatttcataaaataaaggaaatgttgaaaaataaaatatgaacacagtgttgtataaagtaagtcagaaataagagaacacttactgtatgaatctattatatgaaactaaaaaattaggcactttggagtttagaggtcagataggagttacctttgtgagttgtgattaacaagggctgaagcaggcttctagggactgggtaatgttttgtttcttgatgtggatgctgcttgcattgatgtgtttcctttagggaagtttatggaaccatacacttgtgatgtgtacacatttctgtgtgaatgctggactgaactaaaatttatacttacattttaaaaataataaatatgtactttaagtacaggagggacataaatcataattgttttaataaagaaggtgtagctttaggaaaagcataccgcattgttctatttttggcatttcaccatggacccctgaacattttataattgcccagtacagcctgtcagataaatatgtgggcactactgctttagagaaagtattttccaaatttatcaccaccattctggaaccacagttccacaggtcattaggatgctgagggtgggacagttggaagctgcttccccagggatttctccattgttcagttctcatagcagtaagcctgcagcattaaagcactcacaggctctggctgccatttgtgctacatgaagaaaaatgagaaaatgaaagaaacgaaaggagagaaaacaggagtagaaaccaaataaatcagattcgaagagaaagtccctaatcgtctctgtattcagacagtagggaatgagcatgcaattctgcaagcccattcctaatgtgagtttctgataagaatttgctatctcagttgtaatctttctactgagacattcaataaataattttctttcatgtcaaggtaaggaaataacctcacattacccatataaggaaagaatagtatactaatcctcacgttatcactatagaattttatcttttaaagtggaagctagagggacagatgcataatctgggagcttttccagaattgtttgttcctaaatgagacattcagctatagcagcattagcagcctcttctatttgtcacaatgccatatgtagttgggaagatacatgataagcacatacaggatgctgacaactcacgaaggattatcattgcagtcttagaattaatctctaccatatttgaagatttttatgcaagactggatcttcattccacaacccaggtataggtatatgtgccaatacaaaatacttactgttggtttctgagcttggtagaattaggaagtaaggggtaaaaaacaagcaagtcctgaacttaagaaagttgttcatatcctattccatggccactgttttactgactggaagaaaggaatcccgtggattcagtcatggggacaatgcagaagaagatacagtagacagacagagaagtacaaatttctatttatgttccacttttcaaaattttttatctttaaatgttatttttaacgtttgtgggtacatagtgtgtatatatatatatatatatatactgtatatatatatatatatactgtatatataaacacacatatataaatatatactatatataaacatatactatatataaatagatttactatgtatatacacacatacatagtgtatatatgtggggtatatatatatgtggggtacatatatatatgtggggtacatatatatatatgtggggtacatatatatatgggttacacatatatatgtgtatatatgtggggtacatatatatatatggggtacatgagatgttttgatataggcatgcaagtatcatggaaaatgggatgttcatcccctcaagcaattattctttgttttacaaacagtaaaattgtatttttttaattgtttaaaaatgtacaattaaattgttttgactatagtcaccctgttgtgctagcaaatagtaggtggtgttcattctttctaactattttttgtaccaagtaaccatttcaacctccccctcaacccccccactacccttcacagcctctggtaaccatccttccaccctctatctccaagtgttcagttgttttgatttttacctgccacaaataaatgagaacgtgtgatgtttgtctttctgtgcctggcttatttcatttaacacaatgacctccagttccatccatgatgttgcaaatgaaaggatctcattctttttatggctgaatagtactctattacgtatatgtatcacattttctttgtccattcatctcttgatggacgctcaggttgcttccaaatcttggctattatgaacagtgcttcaacaaacgtgggagtacagatatctctttgatatactgatttgctttctttgggatatatacccagcagtgggattgctggatcatatggtagccctgtttttagtttctgaggaacctccaaactattctccattttggttgtactaatttacattcctgccaacagtgtacaggagtccccttttcttcacactctctccagcatttgtaattgcctgtcttttggatatgtcgttttaattggggtgagagaatatcccattgtagttttgctttgtatttctgtgatgattagtgatgctgagcatattttgatacacctgtttgccatttgtatgtcttcttttgagaaatgcctattcgaatcttttgtctattttctgatctaattattagactttttcctatagagttgttttaactccttatatattctggttattaatcccttgtgagatgggtaatttgcaaatattttctccctttctgttggttgtctcttcactttattgattgtttcactgcggaggagctttttaacttgatgtgatccatttgtctatttttgcttttgttgcctgtgcttataggatattactcaagatttgttttacccagacagatatcctggagagtttctccaatgtttccttgtagtagtttcttagtttgaggtcttagattttagtcgttaatccattttgatttgcagttctctgatggccagtgatggtgagcattttttcatgtgttttttggctgcataaatgtcttcttttgagaagtgtctgttcatgtccttcacccactttttgatggggttgtttgtttttttcttgtacgtttgtttgagttcattgtagattctggatattagccctttgtcagatgagtaggttgcgaaaattttctcccattttgtaggttgcctgttcactctgcatcaattttgcatcaatattttttgcatcaattttgcatcaatatttatcacatggtagagttcagcagtgcagccatcgggtcccaagcttttctttactgggagagtttactaaggcttcagttgtgttactcgttactggtccgttcaggttttggatttctttatggtttaatcttggtaggttgtatgtgtctaggaatttatccattacctctagatttttcaatttgttggcatatagttgctcatagtagccactaatgagcctttgaatttatctggtattaattgtaatatctcctttctcatttctgattttacttatttgggtcttctcccttttttcttcattagtctggctcaagatttgtcaattttgtttaccttttcaataaaccaacttttcgttttgttgactttttgtatgttttctttattacaaagtcatttatttctgctctgatctttattatttctttcttccactaattttgggttcgatttgctcctgcttgtctaggtctttaagttgcattgttaggtgatttatttgaagtttttttcttttttgatagaagcacctacagctgtaaatttctctcttagtactagttttgctgtatcccataggttttggtatgtggtttttctttcattttttgaagacatttttcaatttccttcttaatttcttcatagacccagtggtcatttagtagcatattgtttaacttccatgtgtttgtatagcttccaaaattcctcattgttgatttctagtctcattccattgtggtcagagaagatgcttgatattatttcattgttactgaatttttaagactgcttttgtgacctactgtgtggtctatctttgataataatctgtgtgctgagaagaagaatgtgtattctacactcattgaattaaatgtcctgtaaatattagatccatttattctatagtgcagattaagtccaatgttactactttggttgagcttctgtctgggagatctgcccaatgttgaaagtggggttgttgaaggctcctgctgttattgtattgaggtctttctctctcctgagctcgaataatatttgctttatatatctgtactccagtgttgtatatatatttgctttatatatatatactccagtgttgagtgcatatataattgttatatcctgttgctgaattgacccttttgtcattatataatgaccttctttgtctcttcttacagtttttgtcctgatatcgatttggtctgatataagtagagctagtccagctatgtttgggtttccattggcatggaatatctttttccatccctttatttccagtctgtgtgtagctttataggtgaagagtgcttcttgaggtcaacacaaaattgggtcttattttttcatccattcagacactgtatctatttttcttttcttttcttctctctcttttttttctatctttctttcttttcttttctttcttgagacagcatctcactctgttgcccaggctggagtgctgtgacaggatctcagttcgctgcaacctccgcctcctgggttcaagagattcttgtgccttagccccccaagaggctgagattacagtcacccacaatcacgcgtggctaatttttgtatttttagtagagttggggtttcatgatgttggccaggctggtctcgaactcctgacctcaagtgatccacctacttcggcctcccaaagtgctaggattacaggcgtgagccaccatgcctggtcgagacactgtatctctcttgattggagagtgttgtccaggagctgagcctagaaatgggtcctcacaacactgtccagtgccctatcctactgtgactaagctggtatccaagatgcaagacagaatcctctttacttttcactctcctctccttaagcaaaagtaaggagtcacttttgttactgtgggctgcactgcttgaggtgggggaggaatggtgcaagcactcccttagccatgccagctggtgtctccctaggtcacatgccaccctagtcctctagctcttagcccaggctatgactagaagttatctaggaattgcagttcgtgtgtcccagactgcctctcaggtttacctgggactccagagcactttggcccacaatggtgaggcttgccaagaaacttgagttctgactgctgggatgggcgattcccttctggctggggctagttcaaatattccctccgtgcacaggcactgactgaggccagcatggcttttttctctactgtgacagcacagcagttagttcaatgtaaagtcccccagtagctgtactgtcccttccaaaagtgcaaagattccctctctgcactgcacgtccagtgctgggtgattgggaaggtgtggtgttggtgattcaagactgtgtctcctgcctttcctcaatgcctcttttagcaagatgaagttaaaaccaggtaccatgattccgtacctggtttttggttctggtgacagtgcttttctgtctgctcatagttgttacaatttgatgtttcagtgagggagattagttatataggcttctattctgacatcttgcaccactccgtctcacttttttgaattgttgaaaccatggtttatggggaaatgttctgttctggtttttaccctcaagatcttctttgaaaatcatgatttactaagtaactagttggatagaattcatttttaagaaaataatgaataagtagttcccttagatatagcaagcaatgttcttataaactgacacaccaaaacacttaccagttcacctaaacactgaaagtatttaaaaatttatttttaacctttaagtttttctccatttgagtatcttgtgcactatacgctctcctacatatgtctacaatctttggtctgatttattttattggttgttgaatgtcagaaaccacctgaattttgcttgtatatataatgcccagtagagtgcacattggtaatcaatacgacttgatgataataatggtaatgaacactataatttgatagcatcaacttggcatgtatgccagaaataaaccatcataaacttcgagaaaaacaagtctcattaatctgtcatttattataatctccctccatcaagcgtagcctctatatactgtcttttttgccatatgtaagtttcttcttgtatatttcagattagagcttgcctcctcccacacactatcttctatttcacactgctctgttcaagtgtttatgtttctgctgaaggctgtataatctaagataatccctagctattgtaaatatcattcactggccagtcattgcattttgcacaccactgagagagtgattgtgagccaaatagaggagattttgtttccacccagcaacccaaaatgaattgtgtgatttgactattgatgccaattacatggaagttttactaccagaggcaaagctttaaactgcaaaagattaaccccatatagttggtgtcatgaggtatttaatgtatattggactatcaaagcgtctccttacaacaaaccaattatcaatgaataatattcttatcttattgtgacttattgaaactctttaaaaaacatgaaccattcagcacactataccgtctaaattagatatctaaactagccttcatttacatttccttgtttagttttaaatataatttcttctgaattcttagttgttaagagcaggtggtgaaagaatttaaagaagaaaatttgttgtatttattaagtgaaagagctttttgaaatgcattaaatagaagtttgtttctgcccatcagcttatcttctgcatattcctatttatagttcaaagcacttaagagttgcagagtgatttgctttttatgatcaccgcttcatccaggatcatttgccttatatcttcaacattttcagattcttataaatcttcacagttcacttagaggttagtttaaaactttcttcagataagaaattgactagatataaaattcacataatctcagagttagccatagatcaatatccccagtctttttctcaaagtaattgaacatttttgtttcccaggatagttgtatacaagcattttcatcctcaccatagatgattcttgttcttcagtatatgaggggactgtatttgcctgcttgttatctaaataaacatttttattattgtcaaaggaaaaagactctaatacagaaagaaattttgtgtccataggactagcctcattttggaggctgatattaatatttgactttattcattgtgtatttcttggttttgtcatttcacaaatttcccttctctaaatatgcattttttctctacctggaatagatgagttttaaaagacattactgtaaaataaaactgtgctaaatgtacttttcccagaaactctctttattttatcaattataatttgctttggctaagtgttacagaagctcaaggtagaaatgacttaaataaaagagaagcctatttctttctcctgaaaaaccctggaagtttgcagccaaggcagatatgttggccccgctcatttctgttttctactgagtgagttatctttacttggtggaatttcatccacatgttgcaagatggagctctcatgacatccacattccaagaaggatgtaagaaggccagaagaagggtcaaagggtgcataccaattgtcttttagggaagtttcgtgggagctgccatgttatatttccacttacgcttcattggccagatgtctgtcacatggccacatctaagctgcaagtggggctgggaaatgtgtttatttcacatgtgctctgctaaaaactgttcagtcatgaaaaaaaaaaaaagaatattggaagagaactaacagtcttcaacatgtatatttaaaaagagcgttatttttcttttacttatttatttttttttgagtgagagtgttgctggggctggtctcaaactccctggatgaagtaatcctcccacctcagccttctgagaagatgggattacagaggcacaccactgcacccggctcctgttttgttttgttttgttttgttttatttaaggagccctaagaagagtgtaaaaagggcaactttgtctttagttaacccttccctttttttttctttcctaattttatgaactctgattcagcccgcatcttactctggcttactaaattctgccaatataagagtagaagttttcatcatttccctaggtacctactcttctgtttctccatattctcaaagtaatttctcattcatcaacttttgtctgacttagatttaagctactgcttaggaaatgtgagaaatggagaatttggttgtcatagcgctcctacttagagggctaatgctttcctaaattttactaaagttggatcctaagttatataagttacctaaatttaattagcaagttttgcttactaattcactgactaaccactataaaacaaggacctaagtttaaagctgatattatgacaatgtactgaaatttcaagacattactttttctggacacgtaggatggaccttgcataagataaaagagcttatttttaggcacacctatgtgccaggcatgggttcagagccttacatatatcatttcattctcaagagaaccttaattttagagacgaataattttgagttttagaataaataattgtcttaagctcacacatgaagtatgtgccagagtctatatcgtgaccccagttatgaattcttttccactacatagcctgcctccatggcatttcacataggatttcttatgctcaaggattatgttcttccttccagatctatagacatcagtagaaacaacacaaatacgtataatgactttttaaagtctcatatacaagaccaaagtactttaaaaagatgtttaaatttttgaaggtgatatctttatgttcgagatcagtagcagaaatggattgtaattcattacaagatgcttagcaaagccaagtggtaaaggattttctgatgtgcttgaggagtcctgacttgctccttagcaaattcctacacaccattcagcattcagtgcaaataccacctcttggaatccttctctgttcttgatcaattattccattgtctggattcatagaactctctgtttacctatttatcttacaggttattatcatgagtttatatgtcttacatagctgtttgcaacatgttaccattcagtggagtactttttcctacagggaagaggctgtactatataccttttgtcacccctaagtggaatgcagtatggtttcatgttagatgttcaatacatgttaatattttattgatgagcccttaaatgtatataataagcttctcactcaaaagctgtaatattctagaatgaataagtttcttgagaaactctttggttaacagaatctccatttccatcatagtgtattcaataaattattaatgcagggtaaatttccttatatttcctttcatttcgctatactaaggtcaaatcatgacttttaggtgtggatacagcaatatataaaataatctaagacctggatatatgtttttctaattagggaattggagatacatgaacagtctctcatagagaaaaatatatccattagtcactaaagtcagtataacattctggtgaaaggtttgcttgcttgcttgtctgcttacttgcttgtttcaccttctattctaggaggatgtttgtcacaattatgaaattctaacgctttaaaaatctgtttaccctatgaaagttgcaaattcttgcctgtaaggcaattttcacaagaattattttcatattagttttagtttatccgtggatagtctcaaattcctcttgaaaatatcagtgttctcaagggaaaactgcccattacaagccacagatgtggttttttgagagatttctgcctgaaatacaagttttaaaatattctttgtagtttcctagtatggctagatacttgtaggaaatgacaatttagatgcacatttgaaaattcttagcctttgagtaatttatatgtttgaataaatttaaactatctttgttcataaaaaggcaaattttgtctgtttgtcttgaaatgcttttttagtttcttcttcagttctttcacttgtctttctgtaatattcaaaattatagcatagtacttgaaaaccaaggatggtccagtctgtgtcctttgttttgaaggaattttggaatcatcagagatataattctggaatttctttgggtaccttccataaaatagtagcatcctgataaggacgtagatgctaacttttatttttatctcattttctttcccctatctctcagtaatgtaggagtgacccaaggtagctgtttattgggccctcaccaaagtcaatcaatattagtcagctacaaccacaataatgctgtgtgacaagcataccccaaaagaacaataagcacttatcctcatattcacaggcctactttgagtaatctctgattcagaatctgactgtaggttgaccaaacatgtctgatctatgtgtctcattctggggctcaagctggaatggcagtagatatttggggcacattcctccatggctgagttctaaagatctcagaagggtaagcagaaacacatgatggttcttaagacccagatttataactagcgttctctcttccatccatagtcaattgtcaaagcaagtcacgtggcatatccaaagatcagggatagagaaatacacttggcagttagtgaacccatttcaagagtgtgggtgtataacactactacaaaacagaactgagacttgcaacttgaaataccacaccattctagtagaattttattacagtattaattaaacatttttgataaaacacagacaactctgttagaaagcccaacttacaatttgttgatcccacttggaaaggtattctgaatccattttttcacaagttttctttctaattcaatgtgttggggtacttttattttacccagaaaagtaatattataaagcataaagttaatgccccctgtaaaaatagaatactgaaacaaactttaagtcacaattttattatttactgacttgagaatctccttgtgcttcagcacacttggtagttggatttccaaatagcatcatgactttccatacccagctgtctgctgctcaaaactaccataagctgactatcacagctcacaggatacccttgaagaagaccatctggtttatgtctcttggcaaaatttgtttaaaaacaagcagctgcatgacaaagtaagaaagagtctctgtctagctgtggtaaataagtagctttgcaatactcataataaagcatttttctaatccaagccaacatcttcaaaaggaaagcattattttcttacaactgaaagaaaaatctacagaattcagtgatgagggaaggactccattaaatttgtttcagcagcttgagatagtgagaaaaacaaaacaaaataaaaacctgtttgtgattagatacagtcttgtaataactagttttaaaagtatttatttagaatctaatacttggatattattttaattctttatattaagagatttacatttcataaaagcttgtcctttgaaccctaatactcatattgtgatggtgagccggaatgagtaaggtcacttactatatagtcggtatataataattcgttgaataactctctctcctcctgttactggcagtgaatccatacgggtcttcagcaaccttaattcatgcctcctcagaagaaagaattcgaccaaggaggcataaggcagaagaagagactgaggcaagtgttagagcaggaatgaaagtttatttaaaaactttagagcagaaatgaaaggaaataaagtacatctggaagggggccaagtgggcgacttgagatattaagtgtcctgtttgaactttgatttatggttttgtattttggcatacttccatggtcttatataccttctccccaattcttcccttggggtagggggctatctgcatgcacagtggtctgctgacacttgggaggggagcatgcacggtgtatttactggagttgtattcaagaggtgttcccttaccagtcaagtgtttccagaggaaggtcgtataccagttacactatgacattttgcctcttagtgcgcacgcgggagcccatttgcccaactcctgcgatcttatcgggaagctgctgatcaccaatttcaggtgtttttatctattgggagactgcctttccctggtattggctgtgaccaattattattttaaagacacagtttaataaccacctgactgaccatcacttgatggttgcctgacattcctggttggggtggcgggggtggggggtctcctaccctgctcatatctgactagctatctactgtaacactactattaggtatgtctgtatcccattacactcactctctattacaaaaaagagtaccttattcatttttcaaaagaatgagtgaattttctgctccagttaagtgcttttccttacctctatgtagagtgtcaaactagccatgcttaaggattgattctggtattaataatataaattcttgcattatgagtgtctcagtttgggttcttacataagcaaatcctgagacaaggatgtgagttcaaatagtttctttgggcagtgattctaggaagctgtggtaggatgttggagttgtgagaaagttaagagaaagcaacctgtaaagagtatgttatcaagccaaacaccactgtgagaactagggcttaattccctggagaaagtctgggaaggcataaaacacttgtctcagagttatcttagacaaggtgcaggagctgaggtgtttatatttcaactcttgttagtcacttttaaagggccgctcagggtgtcagggtattaatttcctcttgcaactacttccaacctgtttttgcatgtggttgtagctactttttctgcgtcaaagatagactttaggctaagacatgcagtttccggctgtaggacatcaaccagagtaccctggagtgtccaggcccaagataatgggtgagctccacctggatctgtggcaatgtgagggaggggcattattaccctagcaagggccactgcacttccctatccagctggtcactcttctgcgtatttgtgttacttttctgactcctgcattcctctggatcctgattcaccatcagcttttgtattctgaggcttgtgtggctgtgtctttctatttcttccttattgacttacttgtttaatcttttgctaatgtatacctttgatattcctatgtactcacctttggttagctctgtgaattattgagtcttgctttacagctttaaaaagatcatagccatggtttgttttttaagtgtgattcataacagttagtgacaaaattagaagtggaaattaaaggtcacgtgcacaatcctacacaagccaatttcttgaacgacataaaatacttgaatttgtcttttactatcaccaatatagaaataatttgggggtatttctcaaagtattgatttaacaaaactttatttttgtgtgaagattttttcaagtctcctggaaattattcaaattattgtctttaaagtcaaaggaaaggttaatattagggttacttttctttggtcacagaattgctggaggcttctatgacttgctttgaagcagctgactttatgcacagttttggttagaaattcactaccaattccaacattttcaaagtcctaaaagaccaaaagtacaattcttgaaatatccctagagaaagcaagaataaattagttttcactagaaatgaagacaaatttttctcattagttcattttgcctcatgatcagaattctttgccacatgaaaatattttggttaataggttgtaacataaagagtaatatgaatagagatctagcccaattagatgacagaaaaagagcaaagcttttgaaatgtataaagaagaaagtttaagagagacatgaacaaggctggatgtagtttaaggttgaagaacacagaaaaatgagataagtgaagttaagtgaaaatccttcccttactgagaagaaagagaactcaaaattatgtgaaggtttttgttttactttgttttgcttcttaataaggaaacaacagtggcaaatctggggcattaggaatggtggaacttctataacagtgatgtttcaaaggtcacaaaggaaattaaattgtagattgggtttaaaagcactggaattacttccagccccattttttcaggattttgtatgtagcaggaaatagatcaccgcatagctaaaggggagaatttaggttttaactggtctcagtgcaaactgcttcatagttcctttgcatttggtggtgtatgtaaaacatgaaaggtataaacatttattatcataactttattattatacaactatttattggctgcataggaccatgtgtcttcttgcaggtataatcaaaaataaaaagacagaaatgtatcttatatgaaggctgccattatcgctcttatcaatggccataaaatcagatttcttacatgtacaacatatgaaaatatattaaatatgaaacgttttccattaaataattctgtaaatgattttcataacatttctgtccatgatgtgtaaatctgtagatcaaatactgcaagtgtacagaacttaaaatgctttggtcaaaaaaattctcttattaatatgacaatggcgttcaaaagtaaaaaggtaaaaatacagtttagcattaataagtaaactcagaaagtaaaatatattgatcatacagtctgtattagtctgttctcatgctgctctaaagaactgcccaagactgaataatttataaaggacagaggtttaattgactcacagttccacatggctggggaggcctcagggaaaacttacaaccatgccagaaggggaagcaatcacatccttcttcatatggtggcagaaaggagaagtgctgagcaaagggggaaaagccccttataaaaccattggatctcatgagaactcactatcacaagaacagcaccatggggataaccgcccctgtaattcaattacctccaactgggtccctcacatgacacatggggattacaggaactacaattcagaatgagatttgggtggggacatagccaaaccatatcatttcatccctggcccctcccaaatggcacgtcttcacatttcaaaacacaataatgccttcccaacagtcactcaaagtcttaactcactctagcattaacccaggagtccaagtccaaagtctcatctgagacaaggcaagtcacttctgcctaggagccataaaatcaaaagcaagttagttactttctaggtacaatggaggtaccagcattggttaaatacacccattccagatgggagaaattggcccaaacaaaggggctccaggctccatgcatgtcaaatccaatgaggcagtaattaaatcttaaagctccaagataatctcctttgactctgtgtctcacatccaggtcacgctgatgcaaggtgggctcccacagccttgggtagctccactcctttggcgttgcagggtacagcccccttcctggctgctttcacaggctagcattgagtgtctgtggctgttccatgcacacggtggatcaagccctcttctcacagctctactaggcagtgccccagtggggactctatgtgggggctccaaccccacatttctcttctgcactgacctagtagaggttctctctgagggccccatctctgcagcaaacttctgcctggatatctagacatttccatatatcctctgaaatctaggtagaagttcccaaagctcagttcttgacttctgtgtacccacaggctcaacaccacatggaagctgccaaatcttggggcttgcaccctctgtagccatgggctgagctctatcttggctccttttagccatggctggagtggctgggatgcagggcacctagtccctaggctgcacatagcaggggggctctgggcccggcccaggaaaccattttgccttcctaggcctctggtcctatgatgggaggggctgccatgaaaacttctggcatttcctggagacaattttcccattgccttggtgattaacatttggctcctcgttacatatgcaaatttctgtagtcagattgaatttctcctcagaaaatgagtttttcttttctattgcatcttcaggctgcaaattttctgaacttttatgctctgcttcccttttaaacataatttccaattccaaaccatatctttgtggatacataaaactgaatgcttttaacagcacccaagtcaaatcttgaacactttgctgtttagaaattccttccaccagatgccctaaatcatctctctcatgttcaaaattccacagatctctcggacaggggcaaaaagccaccagtctctttgctaaagcgtagcaaaagtgacctttactacagttaccaagaagtttctcatctccctctgagaccacctcagtctggactttattgtccatatcactatcagcatttgggtcaaagccattcaacaagtctctaggaagttccaaactttcccacatcttcctgtcttctgacccctccaattctctaggaagttccagagtttcccatactttcctgtcttcttctgagtcctcccaactgtttcaacctctgcctgttacccagttccaaagttgcttccacatttttgggtttctttatagcagtatcccactctctgtggtaccaatttactgtattagtctgttctcatgctgctataaagaactacctgagactgggtaatttataaaggaacgaggtttaattgactcactggtttgcatggctggggaggcctcaggaaacttacaatcactgtggaagcagaagcaaacacatcctttgtcacatgatggcaagaaggagaagtgccgagcaaaggaggaaaagccccttatgaaaccatcagctctcatgagagctcactatcataagaacagcagcacgggagtgaccaccccccatgattcagttacctcccactggatccctcccatgacatctggggattatgggaactgcaattcaagacgggatttgggtggggacacagccaaaccctatcactgcctttaagatctatgaattgtttttctacattgaagaaatttgtagacatttgttttttattctctttttggtttgctgagagcagtagtctcttggaagtgagtttcatttacattttttcctttgggtgtcaaatatataaaatattttttaaaatcaatggctgagggataaatgagggttggtagaaagggaaaggataagggttgtagttaacggaccatgttttaatgtgtctataattagatggaagttgtctcttaccattcaacatcctggatggccttcctatagaggacattttcatcttcttttgtcgtccagagctagcatatgtgtttcatgtctttagatagtgaaaatcaattcagattttcatggaaaatgctctctcttcatcctaaagacagaattgtcacggctatttcgtttattgaaaagtgaaacctgctacagttagcatatagttaattccatatatgttacctgtatcatttaatacattcacaaagtaaaaaaccaaattttgccaagttcttgatagtaacaatagtaaaatggaatttctgttggcatattttcatgttattctgaaatgctgaatggatttattaagattgataacaatatgttgtacctttatgttctaaaatttaataacagttattcttccaaacatgccagcgtcctcaatagttgacagtctgcaaaatattctattatgcaatcagccatatctccttcttgagctttctttaagtacttgtatcctgtatttttccctgaaatctagcagtaagttgaagaaatgataaacaaaattgtatcattgtatataatggctatttataaatactgatgtacattttcataatgttatttaaatgattacttcagatatgtatttctgttttctacattttaacttctcaacatattaggttgttatcttagattggattttctaagacatagactctaagacagagatttccatgcagatggtttcttagtgagtgcttttaagaaaaatgcctgggagggagtaaaggcagcaggattgaggagagagaggagttgaatgatgatgcagtgaaatggaagatcttatctggtcccatgtggggttgggatgaccatttagagtattaccgtatgaagcaaggaaggtggaccattgtatccctaatccattagtcattagatgtgagcctcccaactaccagcttccgggcaatatcatcttggtcaaagaagtgcctgtctgctgagagaaatttcttggaagagcttaggtatgatctgttagtagataacaatcccagcaactgggagaatgaatgcttcatttgtaattggtgaatctcggtggcacaccacagtgttcgctacggtaatctttatacttattgagacatatattgtttttaagtaaaacttgtatacctagtaatgcatttaggtagtgtattggccaagctagtcctttttggaaacaatttcattgtggtataaatgatatacaataagctacacatttaaatagtacaatttgataagttttgacatatgcaaataccagtgaaactattagcacagtcaagataataaacatatccaatatcctcacaagtctgttttcggtaatcactctctcctgcccctcccttgattcccaggttaccactgatgctgactggcattatagataagtttgcgttttatagaattttataaaagtagaatcatgaagtatgtaccttatttctggtctgccttctttcactcacaaactactaactttcattttgtgaataatatgatctccgtgtgattacacacattaagaaagtcaataaaaacattgtaatttgattccgatactagtttatgggtctacattatgtatttaaagatactatcatgtttggattagcccttaggtatcaagtaaccctggagttgaggcagttactgttttatttgctatcaatctttttataagctcaccttccactaattacccaaaaatatttgatttaatacctgagtacagaaaaagaacatattcacaatgtttaaattttataatttaatattataatttacaacagtttaaaataactagtcctgaaattgagtatttctcacctaatattctgctctatttattacccactccacgaaaaaatttcccagaaaaatcacaaacatgtctcttgagtgtattattacccaacccacagaagaatttccaaaaacagtcgcaaacattctctcttgagtgcaaccattttctcgggccagccattcattgaaacaaaatagcctgtataacttctgtgggtagacatttgtaggttgttcttttgaggcattagtgctattgcatttaagataaagaaataacgaattcacaaattttataaagttctcttaaatttaccaagtcaatagcaccaccactttgattcctataacctgtgacttagttaggcttctcaattccaagaacataccaccattatttcttataatgtcctcagattaaaacatgtgttgtcctttctttatacctccctgcactttaattgaatattttgccatttactggattctgtacactttttatgttttcatgccctcccttttcattctcctggacatcaatcgcaagtcagtagataccttgtaagagatctctctccacccaaatcactgtttcttttgaaagagttaacctttctgaagcagcactcctgcttcacatttcccagcacaggaaccttcagtgtttctctgttgatagctttgatttcaaacgggtagccccaggagaaaagagagctgaaggatatgttttgcttggctgctttgtttgacctgcaaggaacattaaaaggcaatgaaaccgggcagagactggactgatcaacaccatcagtttagcacttattgctatactttctaaggctttacaattttatgtgtcccacgtgtcccctgaaggcatttgattttctaacctcctaggccagaggctaacatccagaattcatagtctggcacttataaaccctaacttagcttctgtcacttgtatctctatgcaactctacagcaaaatgtacttattttctctaaaatacccttattccatacttctttggagtgtaattttatatataaaagtcctcaccacctgtaaacattaggaagctttgattcgaagaagcagaagccatctccatttaactgaagtgaaatgaaacttactggagggataatgtatagttcttggaaatgaaggaaaagaaggcaactgtggcagagggagggcagcactgagagtcaggaactccagggaagttactttttggatgctgtcattaaaatgcttcagcttcaaattgtactgactctacctttctcaattctagattcaaatttctaaatgtaattggcataaattaggaacttgtcccaccagtttatagagtttacagagcactatgattataggtccccctaagatcatgcagaatgagggaagagtaatttcatccaaggaaaagcagggtaccattcaccaaagagtggagatacttattcagaacaattaatgttagatgccacaaaaaaactaaccctgaaatcaaagtggcctaatgaatgcttatttattgctcatataaagtctgatataaatcaggtagcattccttcacagtgactcagggacctaaattgctttcatcttgtggctctgccatgtcaacattgaaacttcagaggtattgacaaaggagagctgagaaattgacactaactatcaagtacctcaggcaagaagtgatgcatcacttcctacactttcccactttccaggattcaatcacaattgcactcacgaaacctcaagggaacatgagaaacataatgaaatcaataccaagatatccaaagagtactaattttcttcaccacagaagggatattggacagacaaaaaattttgggacagaggaatatccactaaatgatccttccatgccctgctcagatgctacattttccattaaggctctcttgaccaacccataaggagatgatctccaactcctctgaacatctggaacattgcattctacttatttttactgtctcctattgtaataattgttggctattccttattagacaaattataagcttttatgggacggtgatcaaaagtcctaatttatcttgtcttcctacagcattcaaagcattgtagaccttcaatacatagcagtcttcgaagccagagtattagtattttttctaaaactgtattcatcgcaacgaactcgatggatgttcaataaaaatgtattgaatagtcattcatgcagatagcaaatttcttaaaacatttcttactcaatgtttacttatattcatcatgaatataaatttaatataataatatcaaatcccattacatttagtacaaagtaaatataccaataattttatatatgtttaagtgaatttttatatttcatattatttgtgaatgatacacatcgtcgtggaaaatttacaacgttgaagtaaattatacaatatagggtatttgtattaaaatacatttcatagaaggtgctttaaatttaaaaagttagcatgaatacatattaaatgtaaaagagtctttaaaatgaaaaatatttcacacttgtgggtttgatctaaaaatatcagtcgctatatgatatggctagacagatttgagtaggtataattttaatgaataatattgtgtgatattttagggtccaaaattgaatgtttctattaagtaacagatatttaaatgccaagcagaagctacactggcaaaacaagatttagtatgttatcttaagtgtatcctaaatcctctttcatcttatggagaagaaatacatgcttttagtttccagccactcctgtctatattcatttaaaataaactattatttatatcagatatgatgccatgtgagtccacaatttgtagtatagagaaataatttcattgaattattttggctgtttgtacctgagacctgattctgaatcatttatttttctatttaagttgtgctattttatgatcctacctatggctatgttcaaaacaatgacaaaatatattttaccctgatctttttttcattattatactttaagttctgggacacacgtgcagaacgggcaggtttgttgcataggtgtacacgttccatggtggtttgctgcacacatcaacccatcatctacattaggtatttctcctaatgctatccctcccctaaccccccatcccctgagaggccccggtgtgtgatgttccccgccctgtgtctatgtgttctcatcgttcaactcccacttatgggtgagaatatgtggtgtttggttttctgttcctgtgttagtttgctgagaatgatggtttccagcttcatccatgtccgtgcaaaggacatgaactcattcttttttatggctgcatagtattccatggtgtatatgtgccaattttctttatccagtctatcattgatgggcatttgggttggttccaagtctttgctattgtaaatagtgctgcaataaacatacgtgtgcatgtgtctttataggagaatgatttataatactttgggtatatatgcagtaatgggattgctgggtcaaatggtatttctggttctgtatccttgaggaatcgccacactgtcttccacaatggttgaactagtttacagtcccaccaacagtgtaaaagcgttcctttttctccacatcctctccagcatctgttgttgcctgacttttgaatgttcgccattctaactggtgtgagatggtatctcattgtggttttgatttgcattcctctaatgaccagtgataatgagctttttttgatatgtttgctggctgcataaatgtcttgttttgagaagtgtctgttcatatccttagcccactttctgatgggtttttttttttcttgtaaatttgtttaagttccttatagattccgggtattagccctttgtcagatgtatagattgcaaaaattttctcccaatctgtagtttgcctgttcactctcatgatagtttcttttgcagtgtagaagctctttagtttcattagatcccatttgtcaattttggcttttgttgctgttgcttttggtgttttagtcatgcagtctttccccgtacttgtgtcctgaatggtattgcctaggttttcttctagggttttgatggttttcggttttaggtttaagtctttaatgcatcttgagttgatttttgtataaggggtaaggaaggggtccagtttccgttttctgcatatgactagccagttttcccaacaccatttattaaatagggaatcctttccccgttgcttgtttttgtcaggtttgtcaaagatcagatggttgtagatgtgtggcattatttttctggcctctgttctgttccattggtctatatatctgttttgctaccagtaccagtctgttttgcttactgtagccttgtagtatagtttgaagtcaggtagcatgatgcctccagctttgttcattttacttaggattgtcttggctatacaagctcttttttggttccatctgaaatgtaaagtaatttttcctaattctgtaaagaaagtcagtggtagcctgttggggatagcattgaatctgtaaattaatttggacagtatggccattttcactccactgattcttcctaaccacgagcatgaaatgttttttccatttgtttgcgtcctttcgtattttcttgaacagtggtttgtagttctccttgaagaggtccttcacatcccttgtaagttgtattcctaggcactttattctctttgtagcaattgtgaataggagttcacccacgatttggctctctgtttgtctattcttggtgtataggaatgcttgtgatcttttcactttgattttgtattctgagacttggctgaagttgctcgtaatgttaggggcagccagagagaaaggctgggttacccacaaagggaagcccatcagactaacagtggatcactctgcagaaaccctacaagctagaagagagtgggtgccaatattcaacactcttcaataagggaattttcaacccagaatttcatatccagccaaactaagtttcataagcaaaggagaaataaaatcctttacagacaagcaaatgctgagtgattttgtcaccaccaggcctggcttacaagagctcctgaaggaatcactaaacatggaaaggaaaaaccggtaccagccactgagagaaacataccaaattgtaaagaccatcgaccctatgaagaaactgcctcaactaacaggcaaaataactaaccaacatcataattacaggatcacattcacacatgacaatattaactttaaatgtaaatgggctaaatgccccaattaaaagacacagactggcaaattggataaagagtcaggaccatcagtgtggtgtattcaggagacccatctcacatgcaaacacacacataggctcaaagcaaagggatggcggaatattttccaagcaaatggaaagcaaaaaaataaaaaattaaaaaaaataaaaaaaaaaacaggggttacaatcctagtctctgataaaacagactttaaaccaacaaagatcaagaaagacaaagaagggtattacattacataatggtaaagggagcaacgcaacaagaagaactaactattctaaatatatatgcacccaatacaggagcacccagattcgtaaagcaagttcctagagacctacaaagagacttacactcctacacagtaatagtgagagacttttatactccactgtcaatattagattaacgagacagaaaattaccctgatctttaacattccaggcaagtatgttttcagtcatacatagtacgtgaatctgttatattttaaatccaagcttttggaggacaaatgatttcacagttatacaactcagcctctcccagactcaagtctctcacttgatgcagtattcccaccccatcttcaataaaagaagaaagcatgaaacatcgcattgatatagggaaagtatatctgagttttctatatagcatataaagaagtaaaataactctgtgatttgtgatgagatagatttagctgcaacaatgaggtctggatattaatattggattaacttcctttgagattgcaacttccatgtggcattcagcactttccttgttttctcatatgtaggccgagaataaaattatcctgtttctatttcccaacatgaaaggtcttttaactgtttgaagacatatgtttcatgtgaaaccaaggaattgctactgcaattttgtaagacagaagttagcaaacttattctgtaaggaacaagatagtaaatattataggctttgcgggccatatggtctatctcacaactattaaactctgccatttttttttttttttgcaaaagcaaccatagacaatatgtaaatgaatgagtgtgattatattccaataaaactttatttttaaactacaagactagttcttaaaataaaatttaacaaagaactattatatgatccaataattccacttctgggtatatacccaaaataattgaaaacaggtattcacacagatatttgtacacccaagttcatagcagcatattttactgtagagaaaaggtagaaacaaatgtacactgtgtacactgaccaagaatggagaaacaaaacgtggtgtatccatacagcagaacagtattctgctttaaaaaggaatgaaattctgtcacatcctaaaatagggatgaactttggagatattccacctagagtagttaaattcttagacaaatagttgcatggttgccagggaccagggaggggtaggggaaatgagcagttcttgtgtcattggtatagagtttcagtttagaaagatgaagagttttggagatagatggtggtgatgtttacatatccatgtgaatgtatctaatgccactgaactgtatacacttacaatggttgaaatattttgtatattttcccacagttaaaaaagacaagcccatgtgcccaaattgctgatataaatctgtattcctattagtgagcagtaatgagccatgtttagtgcagctgatatggttaagatggaacaattgcatgtaatgcaatggtgggtaacatctaataaaaattggtactcaccaatttccatttccattgtggatataaacacccttcacattatgaatcatgttatttgttatttgtgtacttacttattaaatcacttttctccatctctctcacctctatgactctgtacatgtacaaacaacatacacactgtgaacttctttagaatgacagttacattttcgttacttgattcattgtttggccaagtagatacccagtaagcataactagcaagtgaataatgtatatgtgatcattttccttttcaaaaaccacttcttatctctaccacaccaccacacattattatatgctacacttcttatataaaacaaaaaagaataggccaggtgtggtggctctcgcctgtaatcccagcaatttgagaggccgaggtgggcagatcacttgaggccaggagttagagtccagcccagccaacatggtgaaaccccatctctgctaaaaatacaaaaattggccaggcgtgttggcgcatgcttgtaatcccagctacttgggaggctgaggcaggagaatcactggaacccaggaggcggaggttgcagtgagctaagatcatgccactgccctccagcctgggcaacagagcaagactctgtctcaaaaacaaacaaagaataaataagctttaataaactcttttgcagaagagttttcatttttaaacatagaggaaaaagaagatgaggatgaacgatagtgatgcccagaagagaaaattgtgtaagacaaaatcaattgaccaggcgtggtggctcacgcctgtaatcgcagcactttgggaggctgagacgggcagattatgaggtcaggagttcgaaaacagcctagccaatatggtgaaaccctgtctctactaaaaatacaaaaattagccgggcttggtggtgcacgcctatagtcccagctacttgggaggctgaggcagaagaatctcctgaacccagcaggcggaggttgcagtgagccaagatcacgccactgcactccagcctgggtgacagagcgagactacatctcaaaaaaaaaaaaaaaagattaaatcaattttagattgatatagagataaataattccctaagtacaattaaagcaaggatcagaccctgatgagtaaggatgatctaacaaagggctgacaatataaagtgaatgcgattgtcaccaaataaacatctcccaagagctttgggacaatcttcagctaagcatattctgcactttacatcgttctgccatatgccctatgtagcttttcatcctccagaaatttgaatagcacacagtattttttggcaccgagtaattgtggaacttaaacttcctacaaagagagaagctgtttcagtcagctaagtgaccagttagtaagcaacttctattctcttagtgtcgatagggttaaagacagtcataagctccccaaacccttggccgcctcaattttttcatttaaatacttatcttcttatcttcatctattttttagagtcacacataaactctgtctatgaggttcttaaagacctggacaatatatttaatctctgtatccttaaatctcaccatgatatctcaaagatggtagataaaactgttttccctcacttctctgactccataccaatacttaatcgatcgggaaagttttataaaccatttaccgttgaatataaatatatatacacacacaaacatatatatatttatatatatttatgtatatatatatttatatatctatatatatttatgtatatatttatatatatttatatatatttttatatatttatatatttatatatatttatatatttatatatatttatatatatttatatacttatatatatttatatatatatttatatatatttatatatatttatatatatttatatatttatatatatttatatatatatttatatatttatatatatttatatatttatatatatttatatatatatttatatatttatatatatatatttatatatttgtatttatatatatttatatatacacatatttatatatttatttatatatgtttatatatatatatatatggcactatatatcagtgagcaaaggcatcataatctttatttttatttctgtattcatttattcaacatatagtaattctgatcctgtctcaaaaactctacagaaattaacaaagaacacattgtttctgcctttttggagctgaatgtttagtgggggaaaatgtattttaaggcaataatcatatacatgagtgtatatttacaagccgcagtaggtgctatgaatgaaaagtataaggagctatgagatattctaacaaaaagaaatgctgcagtctagagactgagagtaattatctgtgaggaaaagtattgaagcagagacctgcaactcagtaaagagtgtagggagtcacatgaacaaagtcttgagatgttggtagagatcttggaatgttcgaaattctaaaagaaagcccttgtgtatggggtatggtgagagagggagagcgtggcaagttttacgttgtacaagtcattgtaggccacaaaaataagtatagattttatctaagtgcaacggaaaaccattacaagtttattttttgattcttaaattttgttttacttatttatttatttcaagacacaatctcactctgttgcccaggctggagtgcagtgacatgatcacggctcactgcagccttgaactccttgggctcaagcaatcctcccatatcaccctcctacctcagcttcctgggtagctgggactactacaggcatttgccactatgcctggctaactttaaacaattattttgaagagacagggtcttgttacgtttctaagtttctaaggctgatcttggattactgggcccaagcaatcctcccgcctcatcctcttaaaatggtgggattacagatatgagccacctcacccagcaaggtagtgacataatcattgtttttgctgaaaacaatgtactttagggaacctccctgaaaacagaatggccacttagaataccaaagcatagaccaagccttgagatggcaatggaagtggaaataaacatgtctttgatacttatgttaatggagctattagtagcaacttttgacagatttgaaagtggagttgaaagacagtgaagtgtcagggatgatccctgagcatattagataatattgagctggagaacagaaaagaaggggcagatttggaggtggagacctttctagatttatattcaatttgagatacatctgaaacatctacatgaaacgtggatgaaatatctgtgaccaagatacatacgtgggatacctaggcatgtaaataatatttaaagttatgtgagtgggtgcaataacctaaagagagactgtaggtagaagattgatcaggacaaatctttgaggaacttttttttttaattattattatactttacgttctgggatacaggtgcagaacgtgcaggtttgttacataggtatacacgtgctatggtggtttgctgcacccatcaacccgtcatctacattaggtatttctcctaatgctatccctaccctagccccccacccccaacaggcaccagtgtgtgttgttcccctccctgtgtccatgtgttctcactgttccactcccacttacgagtgagtccatgcagtgtttcattttctgttcctgtgttagtttgctaagaatgatggtttccagcttcatccatgtccctgcaaaggacatgaagtcatcctgttttatgaggtacttttaatgcatttagtgactgggtaaggaataaccctgaaaaggagcacaaaaaccatcgaggtatgaagaaagccaggagatgtagtttcacaaagcagccagtggacagtaatggacaccagcataagcttaagacagcagtgatagtgttcatcagtgctgaaaactcattggaagtggctgaccatatgttgattgcgaatgcaatgccttctcccatctcctattgcttttcactgtttccgtcatgtccagagtgaaaacactggggaggcagaactgtgtaccaagaaaaatgttttgtgtcagaggaaacaagagctcattaatttccttttgacccgcatggataggaatacgataagcaggagaaaaataaaacctgctaaactaggcaaataaagcttaatagaaaagagagaaaatattgcttacaaagggaagaagacatttgccacaatattagctaaaaagagagtgaggaaaatccacatttaccatttttattatgtgtttccaaagtcgacattaagtgaatattatcactttgaagacagagaatagattgtaagcagaagaggaagtgggattttttaaatggcatatatttaaatgttgaaaaacccatttccaatactcccactgagatatatgcaataaaaacactccgcaatcagtaatatacatgtgaagctcctaaaaatcctccattgagaagattctataaaactataaagtattattatttctgctatcagaaaataaacacatactttctaagaacaagatgaagaccttaattcatcttcccaggaatatacttgtgtacttaatggttcaaggcgtttgtgatgcaaaaaaagtgggacattatgtacaaaatagttttaatcagaaaatgaaggaagtttggtatggtatggttctagggttgcaagttttcctgcaaaaagggagtacttatggctaggtgatgcagccaaggaagcatctctgaggacaggttatcctggctcctattccaaaatatttaggtctccttgagtgttcgatccttgaaccaaggacaagaatagaaagaaataaaagccacttgtataaaggttgccttcattttgtgtcgaatattgacaggagaaagccagatttgtagcttttccagggataagtgagtctcagacacagttaagagcttggctttggaattagattgacctgagtttgaatcgtggctccatcaatctctgattgtgtgaatttttggcaagttttagctgaacctcaattttctcataagtaaaataggcataatacagctatgattctgacccttgccattagcactctgagctacttgtcagtgtatcctggtctcttcctcaagcacttttccactttgttatttcaagattctttgaaattatgaacagtagctcttgatcaccaaacaaatgggagaccatagattcaaaggaacattttagtaggatatttgataagctttgtatttttttgtgctttgaaaattagagtagatttagatttaaggaactataaagctatatgtttacaaaactttattcagttgggcagttctgactcagtaactgaaataaaattgatgaaaacaaaacatatgttttactgttgtgttcacatttaaagattatttaatgcataaccaaaataggttcagcaaatgtttatacatacatgtacttagatatttgtaattcttatggtagagcatgggaatgaatgagaattctcctaggctggaataaaactaatgtctaactaagaattggcctttcacttcacgaatatatatcattatatataaaagattcatcctttgttaacttatttgtttagcttagtactttctaagtacttttctatcctgtcttggtccctatataagaatgatactattataaaaatgaacatcctattatttcataatgattagcatatcagcatatttaagagcaatgcctatatctttaccttcattattattttcatgtttaaaatcctgataattctagaaaaacaaggttgtaattatccattcataataaaagtcacaccaagttattcttgataattaacttggcatagtggagtgcactgagcaattaataattaattacgtggttactagctcaaattttattgagaaccaaggagttaaaattaatagtattgtgtttgcaatgagttaattactttgtttctttgtttttttttttggaatagtgccataattagtatcctaatagaaacagaatataaagtgggtttctgagtgcttgcttgtcgaggtgtgtaacaacatatattttaattataatttgagtcactaattgttgtcaaatacaattttaatttcttagttcagagattaaaagatatgtaaacagctccaaaaaagaatatgataagatggtttatacaagtaaataaataactatatgacttcagaagttttatttaacaacagttgtataagtgttttaactaatgttaacaatgccttttttgtaaatctcctctaccacaaatatgagataaatttaagaacggcattttcattaaatattgattattaaaattcatatataagtattggctgtacctgagcatttacagtgaaaccatgaaggactggcaggtttggggctgtttgataatatccttccttaatctttcttcgtagcatcattgtttaattttggctgaccacaatcacttatgaaaagaaacagctcaaataattagtataacctctttctcttcataaaaccttcaaatcaatgtggtcataattatgaaagtgtaagattataaaatcttctcatttaaatatacatcttcatattagcagacttggctaatttcttcatttatccttgacatccacacttaaactctgtcaaactggtcattcatagactcattattcattcaacaaagattagtgtgaccctactatgattctgagggctagaaatataaaactgaataacatataaaccctgatttctgtatttatatatacagaaaggaattatgaactcacagttttaatgcacagtgacgagtcctcagttcatgtctgccttgggagctaggcatataccaaagcaggactgtctaacacagtttgggggtctcagtctggaaggatccgggtgagatgatccttgaattgagttctaaaaaatgaggagaaattatccagataatggaaagtttaggagaaattaaccagataatggaaagtttaggaaagaaacactatttatatgtcaaggacaaagtttgaccaaatgtgtctctgaatctaactggctttatgtaagataaaattaaaaaataattgtcactaaggtttttcacatctgcagcaactaccatcatatctggctcaatatttaaaagaaatacttaacgatttttggcatttattgctactataatagattgtgctatttaaagagaaattctagatacatgccaaagtattttcaggtgaagtaatgtgattcgtgggttttgttttgacaaacttccaaggaaattatttttaatataaagagcaatggaggaagattaaacaagattcgcaaatgttgataattgctcaaggtggtgacaggtgcatgggggtccataatatactgttctctttacttatatatgtctttgaagattttcatgatgtaaaattttaaaatcagaattacagtaatacctctttctttgacaatcgttttcaaacttggttcaacaactgaatttaaattacctacatggctataaaaataaattagatatcctggttatttggtctggggtgggtcctggccatatctgtagggtgtgtgggtgtgtgtgcatttagcttcacatttgactctgaagtacgtggaaaaccaattctgggctctacatatgcaattccaatgcctgacattaggtggtgctggttgtgagccatgatttcaggtttgacttgtagagttaacagaagtgatatcaccaccgatcccacagaaatacaaactaccgtcagagaatactacaaacacctctacacaaataaactagaaaatctagaagaaatggatacattcctcgacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcataccgaatccagcagcacatcaaaaagcttatccaccatgatcaagtgggcttcatccttgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaaaggtattcagttaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtgatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactagctgacttcaaactatactacaaggctacagtaaccaaaacagcatggtactggtaccaaaacagagatatagatcaatggaacagaacagagccctcagaaataacgccacatacctacaactatctgatctttgacaaacctgaggaaaacaagcaatggggaaaggattccctatttaataaatggtgctgggaagactggctagccatatgtagaaagctgaaactggatcccttccttacaccttatacaaaaatcaattcaagatggattaaagatttaaacattagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacagggaacctacaacatgggagaaaattttcgcaacctactcatctgacaaagggctaatatccagaatctacaatgaactcaaacaaatttacaagaaaaaaacaaacaaccccatcaaaaagtgagcgaaggacatgaacagacacttctcaaaagaagacatttatgcagccaaaaaacacatgaaaaaatcctcaccatcactggccatcagagtaatgcaaatcaaaaccactatgagatatcatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaataacaaagacttggaaccaacccaaatgtccaacaatgatagactggattaagaaaatgtggcacatatacaccatggaatactatgcagccagaaaaaatgatgagttcatgtcctttgtagggacatggatgaaactggaaaccgtcattctcagtaaactatcgcaagaacaaaaaaccaaacactgcatattctcactcataggtggggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctacacaatgtgcacatgtaccctaaaacttaaagtataataaaaaaaaaaaagttcgttcctcttgttagaattttcatacaaatgcaagactccttattttcaaagagaaaacaaaattttatataaactaatacctgagaagaataggaaaaattaatgatgtatgggataggtactgataagaacctcttcttttgtgtacattgtgataaactaatgtttaacttgagtcgatgtgctggaaatacttgttaaattttcaagaattttgagatctgttaaacacaaccattatcaaaaattaaattatggtaacttacattaaatgaaatatattgttcacaaatgtactagatgcacaaaagtcatcactacctaattcttttattatatttcactattatctacgggtttgttacctgtataatggaatgactgtataatggtgtagtgctaacttcatgtttggtgacattataatgatagcttaaaattaaacatactgggaatattcaaatatgtccttcctctcaggggatctgattgttagacatttaccagcatagcactgtcttaattaacatcatataattgtcttttatccttaagatgttgagccagtaaatatcacaggagagtttgttccttaggttttaatacttgctttaccagtttactgtagcatcatgtgaaaccagcttctagaccagctgtctttaattggtatgtacccaagctaatccttgtcaggctatcatcaacccaagcacttttgaagttatttttattattacgctacagaaagattttatggcctttttgctcttttctttaccctagccctaggatcatataatttcatctcctatttattcctatttatttccttatctaaaatcttacttaactagcttgcttgcctgcctgtctgcctgtctgcctgcttgcttggtttttctttttttctttcttttctttacttctgctttcctttcctttcttttgtttcttccttccttccttccttcttcctttcctttccttctgttccttttccttttccttttcctttgcgttcctttgctttccttgctttcttcgcttgctttcttttcagtaccacaaaaaaactaacaataacaaaaatattgctacaaaaattgtgacctcccaattctatcctcatttcacggacccataaaatgattatatatctatgccaatgcgttctaactacatgatattattattgatgataagagaatccaaccctcaagaaatgaagtattataatgttttagaacacacagaagcatttttaaccaaaatgttccatgtgattttatagggtgcatgttttaccttttcttatttggaaaagtagcaaaagtattaacaaataaaataagttacatactctttgtatataaatctttcgtgtacataataatgccatttcccttctagtgcttccattattgaaaaaaaatagacatatagcaacgtgctagacattgaagttaactgttaaaaagtcatcagagggtaatgttaaaggtggtatttcaggtaataaagcatatgcagaatgattctattggctttatttccaacatgagtgttattagtaccaaggacactgaagtttaaaggaggggagtgatgagactgatcattactttgtcttctgtaacaggacttaggtggcccagagtgatccttgttggttgattggttagttgaacttctatttttgttactaggcctgcagatctgtggaatctccagagtgctgtgtaatgttacataggccacacaccagacactgttccctgaaggactgaaggtggaattggaacaatatgtagacagttcttgttgcagttaccaaggaaatttggttaggattcaggcctccatgtcagaaaaggaagtctattttatgtgctagaaaaataaccctaatcatcttatcttgggtctctctggggagcatgatgatctacctggtcttgtaaactgtatagaaccggctgggttgagacacatatgtctcataacagagcttccacttaaggctataaaatagtggtccctctattgggtatatgccttatggaaaaatatacgttatgctggtacctattataaaaaccaatgcaaaatgattagagatttctaatccaagtgttatcctcatctgctcccaaaatacagcaatgaaaaaatagaaaataaaaaaggatatatttacagaactgtatttacagaaatatatgttgatgacaagataatcaaatacatatcaaatcatgatgtgtatttacagaaatatatttacagaaatgtaaagcagagaatggggcggaagtccctgacagacttgacactgaaccacaaaacaacagtggaagccaggaatttggatgctgcgggatagttgggattaaaattgcttcaagcaaggtgtggaactggagacaaactcagtattcaaaaccagaggctgggctgtggtgcttgcattcgtgaaagaaaacctggggaaaaagtgcttcttcaggctgtagcctgacgctatggcttgcctaaacttatgggcctatgtaggtgtaagaataaagacatagccttgctgctgggaactgtgttgcatctgttctcttgcttgatgaatggattgaaattatccccagtaacattgcagtgcaagaactttaaaccttaaaggggtggctggagaccacgggacgcgatgcacatgcaactactaaatgctagatgaggatacctgaggagagagaacaagacacaaacgtgaacatggacctccaatagaaatgacaatcgaaaacatacatttatcttctctctctcccaaattgttcaaagattacgctaagggaataaaaacaatacagtcataaaatgacaaataaaatggaagaagagacatctgcacagacatatcaagtcaatgagatgaaaattaggacaagtaagccaatttgtttttcaggatcccagaaaaacttgtggattgaagacgctaggtgttttagaaggccatatattcccgagaggggctggaaataaaggggttgttttgaatcccttaaaaggggcaattacatttcatgtccccagctcagggtagttaattagacactactcctctctcatcccagcagacgtgagtgagtggtttgctttctggtgaggctgaaacaacttttggcatttggacaacaggattagttgatggaagagagagccaccatactgaaaatacaggattaagttaaagtcaacatatttaatggtgagaccagcagtccctcttcaccttcttggctcttaagtttctatcctctgggcagtagattataaatttattctcctgagagcctacctgcaatacgaaaactatttttagtcaagttttattgctataacaaaataccatagactggatgccttataaacaacagacctttatttctcaccgttctggaggctgggaagttcaagatcaaggcactggcaggtttggtgtctggtgaaagctcatttcctgtcttctcactgtaacctcacaaggcagcaggtccaagggaactgtcttgggcctcttttgtaagggtactattctcattctggatggctttggccttatgacctaattaccttccaaaggccccacttcctaatgtcatcaccttgagggtgaggatttcaacgtataaattttgcaagaacacactcagatcatagtaacctacaattaatgatatgtaatgatccaccagtgaaatagccagatctgtgcctaatgaccatatattgaagcccaccaagtataagccctacatacgcacaaggaatttccaaaagcatttaatgcctcagttttaagagacaatcaaggatttccagatatttgaacatgtctcaaagatggaagacagaaaccaacataaaaacaaaaagcagaaatattgggaaaaaaacaatagccacataaatgaaacagaaatctctgcagaaagagagacaaggcatagaccttaagaaaactttttaaagatagctataaaattattatctcacagtgagactagtcactgtattcataagaaagaacaagagactatagaaggtggtatttccgagaaagataagggttatttaaattaatagtatagcaggttaagtttttaaattcttaattgtataaatttatgggttaccagtgtaattttgttatatgaatatattttatagtggtgaaggcagagcttttagtatatccaccactggaataacatacatggtatgcatagcagttttagagcaatgaaactactctgtgtgatactataatggtggatacctttcattatatatttgtccaaacccatagaagatacaacatcacaagcaaactctaatgtaaactatggacttcgagtgttaatgatatatcaatgtatgtaagtcagttataacaaatgtaccactctggtgtgggatgttgatagcggggtaggctgtgtgtaatgaggaagggggccagagagtatacgggaaatctctgtactttcccctcgattttgctataaatgtaaaattgctttaaaaaatcaagtctattaaaaatgaagagcagaaataaaagttcaaaagtagaagataaatttgaagaaatatctcataaagcagtataaatagccaaaagcatggaaaatgggagagtataagaatcttagaagatcattctaggtaagtgtttcacaaatagaggtgattttgtcctgcagaggacgtttgacaatgtacggagacctttttcgttgtcacaaataaggaaaggatgtactactggcctcttgtgaagagtgacgcaagaggaatgcaccatgcagccatccacaaccaagaattactcatttcaaagtgtcaatagtgtttatgtttagaaaccttgttctatgtaatccaacattcaaataatagatgttaaaaataaaacagaagagaggcaactgtggagagaaaattatcaaagaagtgacaacatcagttttcttagaactgaagaaaatgagtgtccaggtttaaagggcttactaaatgcccagcacagcaaatgagctaaaaatctacaccaaggctcatcatcataaatttttacaaaaacaaggacaaagagaagttcacagatcagaaatcagaatggctttggacttttcagcaatagccatggaaaatagcagaaaggaacacttcctttaaacttctaggaataattaactttggctttgatttcatatcctatatgaaattatgttcacaaattctgtgatgctcttctattcaagagttacagctaaatgtccctgtcattgagtgtggactagattcagtgactcttttgtgatgatatgtcatttccaagtgtaggttgtagaaagactgtggtttatgtcttgtgttctccatccacgcctatctctctctgtgtctctctttctctctctctctctctctctctctctctcatgcattgcttcttctgtgggaacacatgtcatgagcagccctatggagatgcacgtatgctgagaaactaaggcctcctgcaaagagccacaagaatgagcttagaagtgcatcatttaacaccagacaaatctcgagaggctgcaagcatagacaacagcttaactacaacctcataaaataagctatgccagtcccaccctgctaagccactctcagattcttgaccttcagaaactgccaaataataaacatttttgtttttaagctgctaaattttggaatgacttgttattcaacaatatataaattgtacaccctgataaactataaattgtgcggagaaaataattttcagagatagccttatgtactcccctaaaccttttttccccagaaatctattttcaaaaatatactctaccaagtgaagaaagaaaccaagaaagacaaagaatgtttagttgtgattggagatcagaaggagagtgttttaggcatgattcgccttgttatgctgcaataataagcaattccaaaatattagtggctagaaacacaaaggttgattttgtatctttgcaacatatccaacacaagtcagtcaagggttctgatcattgtagtcactcaggaatctaagctgattcagtctctagtattctatcattctaccgtaacaataagaagctttagcgttcaccatgtcagtcaaaaatgcgtggaaaattttaaactgactcttacatgcctctatgtaggagtgatatatgtcattttcatttcacttcatcatccaaaggaagtcacgtggtcatgcctaactctgaggggacaggggattataatcactaatatttttaagagaggtaagagaattaggaaaatattggagcattagtattacctgcaaagcctaggatccggaaaacagagaacccaacgtgggaggaagatgcaaagtggtgccagaaagatggtggaggagatcctgtaacaacagctgtataacagttgtagagagaaacctgtacagattggagaagaaaatagtgctccaggaattttgttaccaagaaaaaaaaaatctaatgtattcgaatgtattgagaggtggtattcttattgtgtaagagtataatatatgacatgtatgacagacagaagtaccatttaaaattttattaaacataagaattagatccctatctcacactgtacataaacataaaaatggtaaattgatggattgcctaaacatgaaaggcaaagcattaaaatatataaaaatattttggggcatgtagggcaaaagaggtgtcccttaagcaacagcacaaagcaaaaattgtaaagaaaaagacatatatttgatcattttaattaaaaacctgtacaatgcaaagacttcataaacaaagaaaagacataggctcagatagtatatttgcaatactaaaacaataaaggatttatgtcataatttaagaaaaatatttacctatcaatagaacaaaataaaaataacctaacaggaaaatatttttaaagtttaaaaaataatagacagttcacagaacatctgtatgtcaaatacacttatgaatagatgctaactctcatttattattggaaaaattacttcatattagtcggttttcatgctgctgataaagacatacatgagactgggtcatttatacaggaaaaaggatttaatggacttacagttccacacagctggggaggcctcacaatcttggcagaaggcaaggaggagcaagtcacatcttacatgaatggcagaaggcaaagaaagtcccctttataaaaccatcagatctcatgagactaatttactatcacgagaacagcatgggaaggacctgcccccatgattcaattacctcccacgaggtccttcccacaacatgtaggaattcaagatgagatttgggtggggacactgccaaaccatatcgtactaagtgagataacgtactcccatcggactggaacaagtaaaaaataaaataagattgtgaaaggtcacaaactctcattcttgtagaaatttaagttggtacaaccaatttagagtgtaatttagcaataatctagttaaactgaggatggcatgtcctaccaaacagcattccagttaatcacattgaagatagcatgattgttctcaggcttccatattttctgttgaacggtaagttgtcagtctaattggcattcctttaaaatagacttgtttcctcttgatgattttcacattgtaattttgtctgattttcagcacttcaccggtctttaaatgattatgtaagattttcattgctgaggaggaaatcctatcacctcaaatactatcttattagttatattttcattttattttaccatgattttaaatgaattccttaaaaaattaggttagagaactaataaatgataaagagaaaaattattcttcatcctgatagctgttatgtgagggtggaatggtatggctggtttttttcactgtcattttgtaacttggaaattcttattttttaatacaatgacaatattttcatagttaaaaaacactaaaactaaaacaatagtctgttaatgacaaatttaagggcgatttcattaagttaaaaatccatgttaaggcattataagatgaataaatactccaaatgaaaacaaagtgaaggccacttttatttaccttttgtacatgatacttatttttcaacagttgtcatgttagaaaaagttgaaaaaataaaacaagatacacccccttttggcctctaaccttccaaaattgtaatgggtagacttcaaattaaatatctaattcgactcctttccacttctaccctcatagcattagagacatttggaaaaatgaaaaaaatatagtattttatggcagggtacctcaaccccagagccacagacccgtaccaatccgttgcctgttagggacccgattcgcaaagcagtaggtgagcagcagcgggctagggaaggaagcttcatctgtatttacagctgctcctcatcactccatttctgcctgagctccacctcctgtcagatcagcagccacattaaattcccataggagcacaaaccctattgtgaactactcatgcaagggatctaggttgcatgctccttatgagaatctaatgctgcatgatctgtcactgtctcccatcaccccccagatgggaccatctagctgcaggaaaggaagctcaaggctcccactgaatctacattatggtgagttgtataattatttcattatatattataatgtgataataatataaataatgtgtgcaataactgtaatgcacttgaatcatatggaaaccatcctccaacccggtccacggaaaaattgtcttccacaaaatcagttcctggtgccaaaagggtcagggaccactgttttatgggataagtgaaagctggatttgaatccaactctaccttttacttcccatgtgaacattaaaagatgacttaatgtctctgaatctttttttccttctaagtaataactaccttgcagagttattacttgaattggccataaggtaaagaggacaccaaatacagtaaataataacataataataaagaaaccttatgaattctattcagtgatatccatattgaggtatttaaggtgaatgatactgatgtcagcagtttacctggatatgcatcaaaaatatgattgattgatggatggatcggaggaaggaaaagatatgtgatcaaaacgagtatagtaaaatgttcatggtggaatctagatatatagatatcacttgtaatttttaaaaatgttattgcatttttgaaatttgttatgttaaaatattgggtgaaaattctgatgccctggccatgtcccaaatcagttgaatcagatctctggtgtattttttttttaagatccttggatgactccattgtacagcaagtttgcaaaccactattctaacttctcaccacccccttctttatagcttacaaaattatatttttaaatgtcaaatgtcacaatttcactttccttcttcaagaactgattagacttctagcttctcctatgctctcatcttgcataacgttcatttgcacgtggttaaaactgataggcaataaataataacccatctgtcttttcctgacccaacataactaaaaccttcctttcaaggcgaaaatgaactataatctcacagacaagagtagctatagacaactaattctttctggtctctcgtggtcatgggactattcaccactgccgtccctgctgtctatttggtggaccagccagttttactgtgacccataccatggctcttgagaagcatgaagctgccgaaatcgcagttgtagggttaatggaaaacatggtgaagtatagcttacatatatatacaattttggcacaaaatgaagcctaagaaattgtaccgggctgggtgtggtgactcatgcctgtaatcccagcactttgagagaccaaggtgggcggatcacctgaggtcgggagttcgagaccagactgagcaacatggagaaaccctctctacttaaaatacaaaattagccaggcatggtggcgcatgcctgtaaccccagctactcaggaggctaaggcaagagaatctcttccaccctggaggcataggttgtggtgagagaagatcacaccattgcactccagctggggcaacaagagcgaagctccgtctcaataaataaataaataaataaataaataaataaataaataaataaataaaagaaaaagaaattgtaccaggaagtggattgggaatgctctatatattctccccctccaagaagtttttttaatttattgtattgtgaaagatctgcagctatttattttgtgtggtactcttttgcaataaactacttctgcataaatgaactcaaaaactttgatattcatgaaccttcataatgttgatctagtacatcttgcccaactagcccttgggccattccttccatgccactggttgaaaaatatgctccccaccccagtaacatcagcatcagacctctgcaaccagaaagattccataggtaatgaaatccaaatgctggcatttggaagtcaaaccagtgtattttgaaatggaaaggcaaggggaagtgcatggagcaagtacagcatgtgctacaacttcagttcataccctccttaaaatactgtgcaactaaactgtcaattgcccattgatagagatagtatctttttcagctttacaccttccgaattcaacacactgctagcctcaggactaagcgctcaataaatgtttatcaaaagattgagtaaatgaatcagtggtgaaataaaatgtacaaacacatacgcttcatacacgtttaggaagcatttctagtgagctttgtggatattttatttcttaaaggttctttttctttccatgttcatgttattctttattttttaaaatgttgcttctgcttatttctctttctacggcagctatatttacttgcctgagagcacagcatatactgatgttaatcaaactttagatgaaacacctaaaatgatagaaaagaatctgctctaattaaataataaagcaacccctacaggtttagacatgtgccttccggtgtgggaaagaaaaaatttaatgaatgtagtagttttatgccaagaacatttccctcgtgcacctgtgttttaataagatagaatataaaatagcaaaaggggcccgacttttgtgatgatatttactcataaggtagtaagtcagatgtgatgacattttctttgacttagagctgctatacttgggtcagatttcagttcagtaaatttgcagtgaagttgtctttctaacatggtgtcatcctggaactgccctgctcccacagttacatacaggctagggagtgggtaggagtgggggtgaaatcctcttaatgtttatggtgtcagtagattcaaactaaaattagccttacagccatactcctaataaggggcccctggcatatttaattgatttaacaaatttatcaaaaatagataaactgaaatctgccttgaaattaattactgtatctctatttttataagaaaatattttggacccgttccctctgccttatgggtgcaactcccggcagaataggtcatgtctcctgaaaatagttcttattttctttactacttatgacctcttatagcctagaagtttttccttgctatttctagttgaaatgctaatctggcataatttctagttgaaatgctaatctggcataatttcagaactaattttctgttaatgccacttggaacatctaaattcctcctttttcaataatactatatttgtgtgttgcaaacacacacaaatcatactatatttgtgtgtatatatagtaaattccaacttataaaagtaaaattggaatttttttctttctttggaaaattattttataattgagaattataaatgtcacttttttaaatgctgcaacctttgagattggtttcaataaagtaaaacttagtaaacattaagaaaaatgatagcttgatatgttcactaatatggtaaatgaaaacttttatgtgtgtataggctcttgttaattataactaccttcacaggaaaaacagtcttgtggaaggtaatggtgccagtgagagaaaatagagaaagtagaatagtagtaagagagaaaatagaatttcccgtttagaataaagctaagtaaaaagtgaattgtttcagttttatttatgtatttgtaagtgtggtctcatgccatatatattcaaagatagacagagatcttaatctttaattttttatggccaaagaaaatgagtcccatgtaaaagggacattttcgtaagctgatctcaagtggtgtattttgatttgccgcagcagcctatggaagaaatatcattttggctgcctaagaagaaaaatgtcatacctttctattttttattcatactccgcatatttggaattcgtattctcaccatacttttgggaagataacacgaaattgccttacttgcctcgaaatcaaaatctgccattcgttttaaaataaaatggctttttcatctcattttcctttagcagaaaaaagtaagttaaatttttttgtagctgtgttaagtgtactgttcctccctcgttgagaacgaaacaaagacatatgattccatttactgtaattgttttggtttgcccaattacaatagcagtaaaatcatttacacatagtaaaatgtttgagccttaaagggcaagaagactaaatttagctgaagatatacaactttcatgtgccaatgaggaaatgtataaaatcagttatacatattttcctcattcatagatattgaaaatattcatatatgtgtacatgtatttgataacttaatattttctaaataacagaaattatatactgtatatatatttggatattatgattattgttattgccaccattgagcacttactatgggctcagaaaacttcactgtattatttttaattcttataacaaccctgtgaaatatatattatgcctatttcacaaatgagaactctgaaatcaggaaattaaatcacttgctgaagtttacaaagcactgttaggcaataaaacagaatttcaaactcacgtttgcttgtcttcaaattttgtatgctgtacaacctgattgttttactacttgttcttaatttcaaaaaaaatcttcatactaaaagatgatactttgggagttctaaagaacatgtttttggccgggcgcggtggctcacgcctgtaatcccagcactttgggaggccgaggcagaaggatcacgaggtcaggagatcgagaccgtcctggccaacaaggtgaaaccccgtctctactaaaaaatacaaaaaattagccgggcgtggtggcgggcgcctgtagtcccagctactcgggaagctgaggcgggagaaaggcgtgaacctgggaggcagagcttgtagtgagccgagatcgcgccgctgcactccagcctggttgacagagcgagactccgtctcaaaaataacaaaacaaaacaaaacaaaacaaaaaaaaccatgtttcttttcagaaggtatactcatttgaagtggataccaattatttgtattaaaattacttatggataaatttgaatctgcaaaaattaagtgcaacattattttttggcacctgttataggaggtaaaaatggtgattcaatatagtttctacccttagggagcatttagtgtggtttagacgtaatgacactaatgtaaattagagtagaataaattctttaaagcaggacaaaaggagtgttaaagactacaaagtttcagttatggaagataaaattctggagatctattatacagcatagtgcctatagctaataatgctgtttcggacacttaaaatttcctaagaaatcttatgttgtgttcttaccaccagtaacaacaataataaaggggacaagaggaaattttgagtgatgacagatatgtttatagccttcatggtggcgatggttttgtgggtgtatacttattcccaaactctttgattttatatatatatatatatatatatatatatatatatatatatatatgatgaaactctttgagatatatatatatatatgtaaaatatgtacagctttttgtatgtcaatcatacttcattaaggtggttacaaaaaagaatcaagaaaaataatcaccctaataaaaagagtgttattaaagaggggagggattacttctaattggtagtatcagaaaggttctcatggaggaaggtatagaaaaatttaggacaatataagcaacgatactttaagaaaaggaataatataaacaaaaataaaccaaaagatgaagaaccaccaaggatgtttctgaaaaatcaagagaaattccattttgatttgagagtatgaggtacttgtcatgatatataatgagaagtgtctagaaatatgttattttgagcaaatgctgcttagaaaggaggttaggttatttattaatccattcctttgaaatataaatttcatgatcagaaacacgtgagtgtaactatccaataacaacatgatttatttccaagaggatagtatattataggagaagtaggattttttctctttcacaagctaatacagtgtttactgattcaaatgacacttaaaaaaaacaagaaacaaaaaacatacactataagctatccttattcagctatgttattgtcttgcattcctgattagaaacatacaagttagactcccaaagtctcagttttctcatttgcaaaatgaataaaatgatagtacctaccccaaggtgctgtggagtatatttaatcatgtacttaatctgaagttttaattagagtgcatagcatatatttgtggttgcttttgctcctatttctgggtaaaagttcctacacctattatatatgttttgtgtttgaatgaagagaaaggcatcattatttcaaatatcccctctagccaacaaatgaaagctaagacttggaagctaggatgtctaacaccatatcctcttcatgtggactatatagtagaggatatgtaaattaagactcaattaaatgctcacattttataaaggagacccttgaatatatcaaatcctcagagagtatgtcagtttaaacttattaagaaatttaaattatttaacttagcctgctgagtcagtttctgtagctgatttctccaaaaggtcttggtattaaaagtagcattacagatcactaatagcaaactatttctgctactttgggtatttttacagggtgctaattgtgccaaatcaagacattgaaattgcataattttaggttaatattagcataatcctacatattttttcagaagcagtgcaggaatagtacaccctgaatatttttccatcatgatggaattttcaaatatcacaacctttacattgtcagttgtctgctggaacattatattgtgtcaaagagatttataaaagagaagggcaaagaaaatttgcggagttctagacaatagtaatatcagggacacttttgctttctttgttattactaaggagttaaataatcagataccaagcataggtaaagaaatgaatctctaactatttgagtacttatcaatttatctcaaggatatttacggtgttttcccctaagccaaaatagagtgcttaattaaggtccccttagccccctaaaaatcactcaggccaagtttctgatatgtgtgtatacttatatacatattaaagtatatgtatttttgtgtgcactttcagatcaaaaagtcctcgtttatctaaagcaatttcagcttattgatgaggcttttctgttacagcgtcctcctccacagatctgcctgtctagagatttaagcccaataagagtccagcaaagtttaaacaacactttagaaatctaaagaattttaagatttattttaatagtcttagtgataacctgaattgtttgtgagttcttacaaataatgcaatcaacatttaagtaattttattatttttttgtttgtataaatttaaggtatacaagtacatttttgttacatggatatattgcagagtggcgaagtctggttttttgtgtacccatcatgcaaatgatgtaccttttctccattaagcaatttcctatccttcgcccccatcccaccctctcgcccttctgagtctccagtgtctattattccacactctgtgcgcatgtgtacacattatttagcttccacttgtaagtgagaacatgcaatatttgactttctgtttttgagttattccacttaagatgaccaccagttccatccatgttgctgcaaaagacatgatttcattctttactatggctttgtagtatttttcattgtgtatatgaaattgtttattccatacgcaatttgtgtgtgtgtacatatatatatatatatatatatatatatatatatatatatatatatatgcttagacttagaagctaggatagacacacaatggaatactacacaatggaatacattcattcacacacatataaataaaagaatatgtggagatatatctccacatattctttatccaatcatctgtttttaaataatgctattgacttctttagggtgaattttatcaatattgttttggtttaaaacactcaccttaaaagagtcacagtccctaaatgtgcatcctcatatttaaattaggtctcagtaaatttgtgcaaagtgtattctttttaggatggtgttgaacttgctaaattatttatctttaagaatcatcattttgtgtcttttattaatgaaaacaacaattatgtgattgctgatatatttggaaaatgatttctgatgtagattgatttttttattctaaattctgtgtcggtattaaaaatttatagattactaactgtattaatatcgataatactaaattttattgctatttataacttggagtgtactttcatcctcctgaaaaagctgaatgaggtaggcagtattattctgggtttatgtgtgagataactgagactcagaggtaaaatagtgtatccaagcattcatggctcttaaatggaagatataaggggtttgtgaaattactcatggacttttttattcattcattcagttattaaaatgtattcaacatttatcatgtaccaggaacagcgcttagtaccaggaattcaaaggtgcataaaacatcttccttattctaagaggtacatagtgtactggaacaaacagccttgtaaatacataattagaacatgaagtagtatgttaatagaggttttcacaaagctgtggaagcttgtcttatgaagtaactaattccaagggagagaagccttatggaatagtgacattttagatagggtgtcattctaaaatacagcaaaaggcccacagtaaaaaaggaattttggttgttatgaaaattttcagattttctatgttttcagtacagtatacatggtgggctatgtgaatgtttgtatagggaccaaagtaggaagtgaggttgtctgttagagagcgctgagaaaccgaaaatagggagagatgagttggaatatgctgaggaaaagttattaggagttttcaagaaaggccacgacagtggggctagagagaagaggctaaattaaagagtcatttctggtttagaattgataaaatatagagacaagcatgataagaaagaagtcgagaagtaaacgatggtctcaagatttctagcttggaaatcattgactaaaattaaaactaaggactggattaggccattcttgcattgctataaagaaatacctgagactgggtgtttataaagtaaagaggtttaattggctgacgattctgcaggctctacaggaagcatagcaacatctgtttctggggaggcctcagggagcttttactcatggtggaaggcagagcaggtgtaggcatttcacatggcgaaagcagagagagagagttggtggtgggggtgggtggctacctacttttaaacaaccagatcttggagaactcactcattttcatgaggacagtaccaagaggatggtattaaaccgtgagaaaccaccctgatgatccagtcacctctcaccaggccccacctccaacattggggattacaatttaatatgagatttgggtggggacacagatccaaatcatatcaaagacttgcatgggaaaataaggaattgttgacataacatctttgaggttcacatcaaatgttctgatgaggatagtccaagtagcagttggctatatacctcagataagggctgaaatttggagctatgtcataatcagcctagattaagagtcaataatctcctgcccatgggccaattacacccaccacttgtttttgtaaagtagtattgaatcccagccatatccatttgcttatgctccatgtataccttttttttgaacttcaaggcagagttgagtagttgtaacaaaaaccatacggcccacaaagcctgaaatatttgttctcaagatctttatctataaagtttgccaatacctgctgtagatgttagttgaagctttgaaagcaaatgaggtttcataaggcagtgtccatacaagacatttaacaagtttacctataaaaactagaattcctttgaggggaacacatcctagtctccattaagcacagtagaagagtcccctataatgggaaagaggtcactttaggtgttgatgttggtggtacaggtcaaagaaaatttatctttgctgtttattcagaatgcaataagtgaagttatgagaaataagggaaaaaatgtgtagaatttcaacagcgaagagaggggataaaggcatgagaatgagttcctaagctcaagtattataaacactgtgagaaacttaaaatcaaagtatgactccaaacgtatttgaagcctgagaacaaggctcacaacctagggaggattagggatcaataaaatagagtgttacaaagtataatgtcaatccagagttgtaaaaatatcagcattgaatatattgaaagcagtaaaactgaatgaggagactatcattttatatcactgtgtttatttctttgccttgttctataaatatttaaaattataaaatttttattaacagtgagagcagaactaccagagtgagcagatcaaaattgggacagatgcttttcactgcacacacttttatttttctgctgttcatgcattatcttgtacagtgcacatgttttacctaaaaaattaaaatggagtctcctgcttaggaaaaaagtatatattctgtttcaaactatatacaaaaataaaatcccaggtgactaaaaactgacatgagaaaaaaacaaattgataaagcttttacagtaaaatagaggagaatatgttaattaatatagggtaagaaaaaattgcttacacaaatgatgaagcactaatcatgaataaaaataataaagtggactaccttgtatattaataacatctatacatcaaaagacagcactgagagagtaaaaatgaaacccacagagtaggataaattatttggaatacacacataatggatgaaatgtgtgtattcataattataaagaattcctacaaatctttcagaaaagaacagataatccaatagaaaaatgggaaaagttcttgaaaagtgaaccatggcacaaaaagggcttgtggcctgctggcaatattctgtatcttgacctggatggcatttttaaggtgatcactttatagtaaataactaatgtgttttatgcatcatagtaacgttaagatttttgtcatctttacaaaataagaaatccaaacggccaataaatatataaagaatttctaagtcccattaatggtccaggccatgcaaattaaaactaaaatgaaatatcactgcttaccaaccagaatcattgaaatttataagtctgacaattccatgtggtggtgagaatatacagcaattagaaatttcacacaatgttacttggtctgtgaattgtaaatagaagtgtaaaattacactactgcttcttggagtgaaatccatttggcactatttagtaaattcaaagatctgcataacctatagcccaccaatttcacttctatatatacactctacagaaatgcatatgttcatattccaggagacatgtttgggaatgtcatagcagcatagtaatagccccaaaccaaaactacttcagtatttattaatagtaaaatttgctatagtttgaatgtgtctctttccaaattcaggtgtcgataatgtgctagtactaagaggtagggtgtttaagtggtgattaggccatgagggctccttctttgttaataaaaataagacccttataaacaaggcttcacgcagcattcagtcagcttgctctcttgcccttctaccttctgccttgtgaagatacagcaggaaggccctcaccagacaccaaatgccagagcctttatcttggacttcccagcctccagaactgtgagtgaatacattggtattatttgtaaattacccagtctcaggcattttgttataacagcacaaacagactaagacaatcatacagtgagaaattaatcaacaactaataagcaaagaggtagattaatcttgaaactatgatatagagtgttccatttggctgctggaagttttatttcttggtctgggtgatggtcaccatgggtttatatgaatggttccctatattatgtttcacaacaaaaagcatttaaaaagtaaatatatgtaatgtactcagggataggcatggccaaccatggattctatgctgaaataatgattcagatttcatcagcaggctaatgacactgcctatttaaatactttaagtcctgaaattaaagaaggtaatttctcaagaaggaatttctaatttatgggtgggtctattccccaccagagagacactagcatggctcagattctatgttggtcattttatttgcatttaaagtcttaagccaaatagaggtacactaataatgacaacaactactactactcatacttgtggaacactgccagatgctgttttaagaaatttgcattttcatttgtaactgagcttacttgaatcttctctctttttttcttggttaatctaactactggtctatcaattttacttatcttttcaaagaatcaacattttgtttcattgatcttttatatttttgtttcaatttcatttagttctgctctgatctttgttatttcttttcttctggagctttgtgttggctttgttgttgattctctagttccttcaggtgtgatgttaggtagtcagactgtgaactttcaggctctttgatgtaggcatttggtgctagaaaatttcctcttagccttgcttttgctgtatcccagaggttttgaatagattttgttgtgaatgtgatgaaaacggaacatttgtacactgctggtgattgtaaattagtacaacctacatggaaaacagtatgaagatttcttaaagaactaaaagtagatctaacatttgatctggaaatctcactaccgattatgtacctagaggaagagaattcattatatcaaaaagacacttgcacgcatatgtttatagcagcacaattcacagttgcaaagatatggaaccatcctaagtgccagccgaccaatgagtggataaagaaaatgtggcatatattttcatataccgtgaaatactattcagccacataccatgcaatactactcagccgtagaaaataatgaaataatgtcttttgcagcaactttgatggagctggatgccattattctaagtgaagtaattcaggaatggaaaaccaaatactgtatgttctcacttataagtgggagctacgctgtaggtacacaaaggcagacagagtggtagaatggactttgaagactcagaaggggcagagtgggaaggtagtgagggataaaaaattacctttggggtgtaatgtacactacttgggtgacacgtgcactaaaatatctgattttacttctatacaattcattcatgtaaccaaaaatcacttgtattccaaagactattgaatttgaattttttaaaaacattaataaaataaaagatgtaaaaaaagaaatttatatatactcatttattgagctcccacaattaaccttaggaggtaagtacttcataattggtagtatacttatcttttactaaatatttgtattacttgggaagttgagggttggggagaagtagcaaggtactatgatttggggcagataactaacttatttattcgcacatacagtttggaccatgagacacgagctcaggtccctcctcctcacctaatcaaagatgaaatatgtgggatgggatgaaataatcagcagtccaatgctgagtttccagaccgaagtataaagcaacaatggatatgtcagaagtctactagggtgttatttatttaaatctatttcatggaatttactaccaccttaatggcccgaaagtgttaaagtatgccccagagtaccgaattactccctaaatgtaatttatgcttgagaataatctgactaacttgatttagaacatcagaaaataagttatgctgcacataaatgaagcagcagtgtaattttaaataccggttgcacggtgaatgagaattttaatatttgcaaaattctaaaatcacttgatttattatccttatgtttatactgacatttttttgccctttgttaagttccatccatatttcttcttactgccaagaaaaaaaactttttttcctagaaatattacagaaggcaaaaattatatttgtttccctgaatgctatttttgatgtctctacttgtttctcattgttaccatttgcttcattcatgggcagcccaattaatggagcgagacaaatttagggagcacagtgactaattagatattaaattggtaaatctaactttgtaaaaccagaaaaaatatatatatatttttttcatttggaattttccttggtggaaaagagtttaaaagtagtcatgataaaaaatgtaattttacgtagtaaattcaagaatagatttagactgtgctattaacagcacctattaaatactgaaaagtgtattttaaaattttatgtgaggcttgaaatggagtctaaagtattattactcacattaagtgtcatcacatgtaaagcccatgattttattctttaatattttgtttgaatagttacttatttcaacagtaatttcaataataaaattaaatcaactttacagttttcaaaggtttagcagttgcatgctgtaataaatacttcatatttatatatttataaagtgacagcataagtcatttttattaggtccttgaggatgcaaaagtttggattatacgaggagacgagagaaaaagggaagaagggcatttcagaaatatgctaccgatatgcaaattcacaagtcctaagacagtagcaggggtcgggcagaaagtccatcctgcctccctcttgtgggcctggaacaatggtgtaagtggaaggcctgttccccttctcttcctacctccagctctgtcttacagagctacggataccatgagcaagtgtatgaacccttacggttttcttctcttgggagaatgtaaaggaaagataacttgtagaaacttgtagataacttgtaaaaaggaaaagaattcagggtgagagggggatttgttgaatttgatagaggatggcaattaccaatatgatgagtgattgagaaacaagtctgtgcaacaggtttgaaatcgaaaatctttgaggtgtacaggatcctgaaatgaagaatgggcatttatagcagtatgtcagagaaacagtcacctcctagtagctaaaagtgttggcaaaagtatagttcaagtgattgggtaggaaaaacagcaaaccaagagtggagactgatggttgctacaaaggtggagtggtaagtcgtgaccaactggtacttctctgtgctctggttagctgctgactgtttctcagactgtggtagcaggaggagggttggagttagcagtcatttgcatatgagactgccatttaaaaaaaaattttaaattatttcatttttctgactctcaatatgaaaagcacattgtagacaaattgaaaaatatagaaaaattatataagaaaatatagtctcaccagtatggaacaatgctaactatgttgcatagatttttagattctcattcaaaagcaactctttgactccagtgatgcaaatgcatgtaacatatgcaatgtgcaattcatttttaaagggaataaacttacgatatattcataggtcatttattgtgtgttatataccattgaaaatatatgaatgctaaattattagtaaacatgcaaaaacattggcaagatcattttgttgtggaaggatatattgtatctgaataactctagaataccataaatcatcaaaggcaacattcttatttttcactaactacagttagagaatacctcttcggctaccttcggttgccttttttatgctaccaaaatgctgtctgttttacaagattttaaaggttaagcatataattattcattaaatacaatgagtgcaatgtacatgtagatacattattaaattttgggtagttaataaaaataaggggaaaaaacctctagaactatcacttttaattgtttaactgataaagtgaagcttcatcttggaaaaataatttcacaagagagcatgtgcactggtagaaaagtgccattgaaacaagagatatttgggttagaagcctctctctactatttaataccattttcaccttttggcaaattacttggcctctgttttctccaatggaaaatgggaataataattgttatgctgcagggttattgtaggtgtcaatgaaatgatgtgtctggcactataaaagcacagagcccggtgcctggctattagtaactgtttaataaatgttaattcctttctctgcccaggacatcagtaggcagatgtagcaatttaaaacttctagtgttactttaaattcctgaatgaaggtagaggactgaaaagatatcatggtattcaaaagtatgatccattgcttcttaagaatagagttcagaaaagcttgacagattcctgtactctgaggcagcaccatagccggtaatctgtaggatggctattggttttgtgctcacaaatgcttgcttgggcaggccccaggaaatctggtagactgtaagcccagtaagatttcaaatcttactttacggcagtgtttttcaccttgactgtacattgaaatcacctggatgctttgaaaaataacagcgtcagtgtccaacctccagaaatactgattaagttggtctggaatggagccccaggatcactgtttggttattgttgttgctgtgttttaaatgccccagttgattcttatgtgcaactgtcttaggtaaacatacagccctggttcatattatttctgcctcagtctcttttatgactggaaggtgaccaaatgcttgtttcctaatattctttccatgtgtagtattaacacatttgacttgtactaagttcctgcagtattccaatctaaaattttagtgactacaataaaataagaaggattaaagaaggcatcgcatagtttagtatatcggttatttaatgcttacatgtgagcctacaatatgaattatatctgtcatcttattttaaatattgacagaatctttaatgatagtgacgaattattgatttattggtgtgataatggtattttagttatatttttaaagttttatttgtaataactatatgtatttatggggtacagtgtgacgtttcagtgtaatgtttcattgtgtaatgatcaaatcaggtttcttggcagatccatagcctcaaacatttataatttctctgtggtgagaaaatttaaaattctctttcactattttgaaatatacagcacaatattggtaactttgttcatattactatgcaatagaacactagaacttattactcctttcagttgatgaacaggcagttttggatcaagaataatattgaaagtgatagaatttatgaagtaatttttatccaaaaatattttgaaagggaatatattgcttccaaataatttattacaatgttaagatatttgtaaatttctagaattaaaaaaatatatttttaggaaagaaaatgccaatagtccaaaatagttgctttatctttcttttaatcaataaatatattcattttaaagggaaaaattgcaaccttccatttaaaatcagcttttatattgagtatttttttaaaatgttgtgtgtacatgctaggtgtgtatattaatttttatttgttacttgaaactaaactctgcaaatgcaggaaactatcagagtgatatctttgtcagtataaccaaaaaatatacgctatatctctataatctgttttacataatccatctatttttcttgatccatatgcttttacctgcaggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggtaagtctttgatttgttttttcgaaattgtatttatcttcagcacatctggactctttaacttcttaaagatcaggttctgaagggtgatggaaattacttttgactgttgttgtcatcattatattactagaaagaaaattatcataatgataatattagagcacggtgctatggactttttgtgtcaggatgagagagtttgcctggacggagctggtttatctgataaactgcaaaatataattgaatctgtgacagagggaagcatcgtaacagcaaggtgttttgtggctttggggcagtgtgtatttcggctttatgttggaacctttccagaaggagaacttgtggcatacttagctaaaatgaagttgctagaaatatccatcatgataaaattacagttctgttttcctaaagacaattttgtagtgctgtagcaatatttctatatattctattgacaaaatgccttctgaaatagtccagaggccaaaacaatgcagagttaattgttggtacttattgacattttatggtttatgttaatagggaaacagcatatggatgataaccagtgtgtagtttaatttcaacttgtggtgtcctttgaatatgcaggtaaagatagattagattgtccaggatataatttggttgctaaattacatagtttaggcataagaaacactgtgtttattacacgaagacttaattatttttgcatcttttttagctcaaattgttcatgttgcaatagtcaatcaagtggatttgaattgtagccaatttttaatgccagaaaatactgattaagacagatgagggcaaaaaacacccagtagtttattaaatactttagatatttcaaaatgctggattcacaaaagcagtatcacatttgactttacaagtcttcattctcaaatatgtttccatagtaaatatgccctttaatattaaggagttaagcatttaaacacctatttatatgataagctatttaaacacagaaaatatttttaaaaccttgtgtaattatatgtgtatcaatcaaacttgcatgcacaccagcgttggcatttgtatagagaggaaatgtatggattcccaatctgctttaatatagaagatacattttaaaaatagcactgaagtgaattttgggctaatgtagcataatggggtttctgcctgagaggcagaaacatattagagttatataaaatgttttggggtagatatagaaaccacttgccattttcaatgatatccaacccaaggtagttatatatttcaatttatattttattatcaaattagtacttattgtgaaaaaaatcaagtaacatagaaatttgtaaaagtacctccattctactctttggaggatagttgttcagtatgaattttgctacatatttcaggctgggtttcttggaaagccattgtaaaatggagatttgtatgtagaaggttaactagggagtacttttacgatgaagcaatttgttttgatgtaacttggtgtagttttcttcatgtttcttgttcttgaagtcagttaagctcttgaatctgtgcatttaacatttcatcaaatttagaaacctttcaaccatttttttaaaaaaaatggaactccaattgtacatttattaggctccttaaagtgccccactactcactgatgttatgttcattgtctgtttggtctctcttttctctgtaatttgttttatataatctctattgtcaaattgactaatctttttcaaagtctaatctatggctaatcccatgtagtatatatttttaacatcagacattttcatctcttagaagtaaaagttgggtctttttatttcttccatgtgtctactcaacatgttcagtctttactttcttgactatatggaatacagatataataactgttagaatattcttctctactaattttatcatctgtgtctattctgggttaatttaaattgatttatttttctcctcattaagtgtgttgtttaactgcttctttggatgactggtaatttttgactatatgccagacattgtgaattttaacttagcgcgtgcttgatacttcaaataaattcaaatatattgaaataaatattctcaaacctcgttctggaacacagttaattcacttggaaacaatttgatcttttgagaatcttccttttatgctttgttatgaccagaacagtgtaagtttagggctactttttccccactactgaggcaaaacccttctgagtactctctctgatgtcctgtgaatgataaaatttttcactggggctcgtgggaacaggtggtattactagccacgtgtgagctctggtgattgtttcctttaattcttttgtgaagttctttccttagctttgagtggttttcttgcatacatgaactgatcaagactcagatgaagaataaaataaagctttctacaaatctccaaaatttcctctgtgtatatatcacctctctggtattttgccctgtgatcactagtcagccttgggctgctgaaactctcagcttcatcttttaacaaaagcctcctggcaaggatcactgtccttcaatgtctgatgttcaatgtgttgaaaaccgttgtagcatatattttgtctttttttttttttttttttttttaagtgtttcaggtgtttcaggcaggagattaagttcagcctcctttactccaacttgaaaacaagtccaaaacaaactattttgatgtaatttgatcttttaatacattaacattacacaattttgtgaatatatcataatttaaaattttcagagaatgtctaatggtcctcatttcttgacagtgtggtttagttgaaactgatgaacattttatcaaaacttttcccctcaattggatacttttttttttttgagatggaattttgcttttgtcacccaggctggagtggcatgatctcagctcactgcaacctctgcctccaggcttcaagcaattctcctgccttagcctcccgagtagctgggattacaggtgcccacccccacacctggctaatttttgtatttttagtagagacgagatttcaccatgttggtcaggctggtctagatctccgacctcaggtggtctgcctgtctcagcctcccaaagtgctgggattgcagacgtgagccaccatgcctggccaactggataattttaaaaagaccattttatttagtctattttttctcaatctatagatgagataagaaaaatcattctagatgtccaaggaaaaattctttcagaaaagagctgtgaatgatatcacaaaccccccaaacagttaaggtatttctttcctggttattttatgtccaaaatcatgcatatgaacatgtgcacacacatgagcgtgcacacacacatgaatacatatacacgcacataatgtaccttaggttatctttccattctgagtaattatcgtaaaatgggtaaaatcaaccccgtaagataccttcatcgataaggcaaatcaaagctttggtaatttctgctatcttggcctttgttgattgactaataatgaataagagaatgagtttcaatatttactatgaaattattttagaagacaggatgtagacagtggctgttagcaggcaattgtttggcatgagccagtaatggttactgtgaaaaaaatcaaccaagcagcccatatattaaacaaacacacgcagaagcacgttggagtctgaagcctcatatgtacaattttcagtaaagaaataacttttagatatgaaataaacaaatagatatatgttgtaaacttgtccctatgtattttgatcaaattgcatcatatttttttcactttaaagaagagaatttagtgctttaactgagacttagtgttatcattcaaaatatactgactgccaatagcagtagaaagataatctggttccatgcaactctattttttttcctctgtcgcaagtaaaagacaaaattaagtacatgaattagtgctttttgaagatattccagagcaatataccatgccactatggagaacctctctaaaaatatcccatttttttacctgagaaaaatattgatcatgttatatgccactcaaattggtttattaaattcgttgaatgatatcagcatctcttaatgcattcactaaacaagcagtaattgagtgcatatacaaagttttatcatccaccaaaacagtgacaatccacatgaggctctaatagaagtttagaaagggggttaagtggttaaatgctggactcagaaagattggattcaaatcccaggtcctttagcttaatagttgtagaatcttgtgaaaatatcttaattcttttcatgtctctgatttctcttctctaaaatggaaatataaatgagatgtgtataaagccacttggaatagcattttgcacaaaataattactcattaaatgtaagcccctattataactaatcactctttataagtgattagttcatatcaatacaaactaagacttatttactgaattatcgtctctaaacatccacactgcagaaaaaccaacctggaaatttcataaaaccttatttttatgtagtataatttcttctcaaagcataagggctcttggattaggaattgaggaaaattccaattcagccaaacgcatctgtttcagatagctgacacttctgcctactcatttcctagctaacaagaagaaatgttaatgggagttttcaaaggaaaagctgaacaccatgaaggaaagtgacacaaataatgttagctcatatattgacagggtgaatttgtgtgctttcaagtcccttcagtgaaaataggaaagtagaaattataaaatgccctaacatttaaagctagcatgttcttggagactaggaaaaaataagttttaaaacatgggctatgatagaatgagatggaaaatgtttgtagttgccagtagaaacaataacaattaccattagattaagtatttaaaccagctgaatatttttattaatggaaatggcatctgttttatgaaataatgctgctgaatgaaccatattaaaaatgaccagtatttcctgcagaacgttgtcgcagacatacaagcctgagaccctaaaatcttaaggtattccatttgaaatcgaccttaagacattaacagtagtggtattgtttagatgaaattttttaggctttaaatcaacaaatgttaagcagacatggggagcgaaacaccagtgtgttattctgacatgaataaactgctgtttttagggaaaaaatatagtcttgttaaggttaagctaattggttttctggtatcttttgcaatgttagtgtgttttactgctccataacctatgttatatggtaaatgtgcaatatatttatatatgttgctgtaaagaaatgtaataaaaaactgtttactttgtgatatgaaagtaaaaatttattcattgtcattgagcatacagaagtaaatatggattacatatgtcatattttaatgttcacatggtcccaccatcaaatgttgaaaaacttatagtttaacgtcatattctattgaagaaaaatacactcccttttctcaaatgtgaaatgtccagagagaatggaaaattacatataaagcatgtagttatagcatggtgaccctgctgtgatctctcagatgaggaacaaaagggagaaagaaagagcacactggtgctttggagttgagagaaggcaaaaaaagagtacaaaaatgtcaaagccaagtttagctgctcttcagctctccctttagctgctcttcagctttaccttaccatggttattagtgattgaagaaaattctaaagcactttttaaaggacccaattctgaagagtttagattcagagagcacaatggagttggagtgactcctgctcaaaagtttgagacaagcgagtccatgaaaagaccgtcctcctcttaatggaaatacccaggttttctcattcttctcgccttgctttcagcactcgcagcccagaaagcccttatctaacaggtactgccgttgaaaggtcattgacttgtacaaaaatgatgagtgctgaatagatgtgcataggtcactgacagtatctgctacagagaatgagttttcgtatttttattaggatacacctaacatggcaatctactgcctcaaagaactctataggaggtaagtgaatttatattaatacagattgaattaaaggataatctagaaaaaggcatatgatgtaaaaaaatcagacacaagtatattttctgtatagtcagtttttacattgtgatttcaccagctggctgctgagtttgacggcttcttaacagccacactgctgagattcaaatgctgatagaaactttgatggaaaaatcactggagtaaatatttctaccatctgttgcccttcactgggaccctaacgttaagaataattcataccattgcttgtcctttatatttccccagcagtaataaaatttcataagattttgttttgtggtcacaaagctatcctggtttctgtaactagaagacatacactagcataagggaatcagccggaaaatttactgctaagagaatttgtctctagtcacttactttaaggttacagcaatgtgtaagtgtgggaatacattttaaaatgagcttttcaaagttattagctggtagtggcatgagagttaagtctcttaatacagttaaacagttgggcacttcatccttgcgtaaatattgttacccttttattgctgcttggaaactcctctgcaactttttggcccctatccatcttttcagaagtagtaaataaccaatttactgggagtgtggtaccaggcagaaattccgagaggggctttcaatccttgcccatcaagtgtatctttcagaaataagtatattaaaataattggataatttcagtggcttgttattagacttccgttgtccagcatggcatgtttaagaagatgacagattttcatacattattggaaagaagcaagaacaaaaaaacataacttactgtagtaaccacggtaaagaactgcttaaaatgcaggataaacatgtcatccctaagggattcccattcttagagcatgaaattatcaagagagtaagagactacaaaaaatgagaagaatgctgattgcaaattccaaatagaaaaaatcaaaacaaaactgcgcaccatcattctggaagcaatgagaagcagaaattgtcatttaatgaaatgtaagattaaagttaatagaagtaattttcatgaaataatattttgcaaggacgatgttccagccatattgatcttcgtgttttcttttcacatcccttcttactgttccctagaatgcttgtttctacctttaaatttgcttttctctctaccagagggctctaccctatctccagtttctcaccatgtcccaatctactccctctcagaatttttgtacacttccctttatatatatttgtgctctaattttatattcacagatatgccttttgtaactcccccatcttaaagaaagcacacacgtacgcacacatgcacacacacaaaattgaactctttctgggagatctgcttaactttcttcataactctgtcacttgctgaaactgtagtatgtgttttcatgtttattatcttttccattagaatgaacatattttgggtacttggtctttctcgatcaccaatatacctcggtacgtagaaaaattgattcatatattgaaaatgtaatattcagtagaacgaataaatacataaataaatttaaaaatgatacttttattgtattacctgagacaaatgatccccaagtttgtccttgcttttcatagccaaaacattctctcttacattgagcttccttcacctcttctgtgtacagagcacttaaaattttcacattgcctgatactttaacaatatgatggccctgttctcttacccattggagcatatgttaaataccagaacccatgtaacaaacatatattgtgatcctactgtgtgcaaagcagatactgcttgctgctaggaatacagagctgactaagagctccttttctctttatgagctcacagtctcatgagttcaacgtcttaaggcacaacgtctaaagcaaagggcagtaagtaaacactccagaaagtactggatctggcctaggacaaatggtgggttgtttttccagctgttatttttcctgccccctaattgacagtcctccattacacctctgggatacctagtctgacttgggaaaacctgactttgggaatcagaggcagtctctcttgcttatatatgaggaactctaatggatacttactgtcattagagaaactctgcttctagcctggctccttttgtaaagaaggttgagtccccttggagagcctgcagaacataaccatttgcatgtaatgaacagtttgtaatactttgagattgatgtgcaatttctatttgacaagggaaaaacaattaggattaaccgtggtcgtatatcccagaataccaacgttgtttccacactctaagtgttgttgggtcattatatgagattcataattttgtcctgttgtacccacgtttgcattaccattcagtcttaatttattataccctattaaaagtttttttggtaatttgttcttattgctactcaggcattaaaatgtctgcaggctgtgaaaatgaataaatttaatgtggcagcatagttctcaaaatcctggctttacaactcatagtacaggcttgtattgtaaatcctagttaacatggatttatttgaaaatccaattttactgctaatcttaaataacacatttttcaaacattttatccttgaatttctatttttttataatttatggctgttgtatgtatttacaaaaggacaatgtgtgtacttttaaatactagtaatggattgctgaaacaactgtaactttaaaacaatgcaattgttaaaaaaataaactgtgcagcctggcttaatggaggcttatgaacatatgattaagatatatgctataataagcaaattcactcaactgatagttcataggaactttcaaatttaatctcataaccagtgctatccttcaaagaatggtcagggcaatttaacgagtacatgaccacgcaagataatttcattgaagagtggctgaactgttgaaatattttctagtctccttgggatatcattaagagcagaaattttgaaatggaattgtaatgatgttcagaaaagataagtaggtaactctcttaatacgttttgtgctgctgtaacaaagtacctaagactaggtaataatttgtaatgaacaaaaatgtattggctcacagttctggagactaggaagtctaacattaaggtgtcagcctctggcgagggcctacttgatatgtcatcacatgatggacgattagagggcaagaaagatcaaaagggggctgaactcccacttttataagggaaccaaacccactcgtgagggtggagccctcaatccttaatcacctcctaaagctcccaccccttaatactgtcacaatggcaattaaatttcaacatcagttttggagggaaaaacattgaaaccatagtagtgatactgactactaccacacagggcttgggaggctaccctagctgttgcacccaagagatgaatcttctaatgtgattacctttatcattttttttactttattaaaatacttttattttacatgtatacttttgtctacccaccatttccatgtctgaccactgctactactatgtcctagcataacattccatacatccttaaaaccaagcaaagggtggagttccatctttaaaaactaaacaggcattttggacaacacattcttggcaatggaatctggacaacatttatcaaacatggtagggaaggttctcactctgcattatcaaaacgacagccagatatcaactgttacagaaacgaaatcagatggaaaatttttaacaaattgtttaaactattttcttagagagacttcctccactgccagagatcttgaatagcctctggtcagtcatctggaagcaattcttcacataattcatgaacttggcttccactttaggaagagaaccacctttttctatacttgcttgcatttttgctttaatgtcttctacagaactaggtcctttgggtgttttaggagtttttccttgttttgaaggattcttgtccttttgatcttggtgttgacggttttgagtcttttccattccgatttgacttttgtgcatttttggctggagtatctcatatagatttcttcactggcgctttttcttcagtttcctcatcatcaaaatcatcatcatcatcaaaatcatcatcttcatcagcagcaagttttacttttttctgtggaaccttgctaccacctccaggagcagatcgctttccagatatacttatgagtttcacatcctcctcctgttcgtcttctgactctgtatcttcctccccagctactaaatgctgtccactcacatgcactggccctgaaccacacttcaaccgtaagaccactgatggtgttatttcaaagccctcaagggaaaccatgggctgtacagacattttcaaagctgccagtgttactttaattggactgcctttgtaactcattgcctctgcttcaacaatgtgcaatttatcctttgccccagcccctaaactgaccgttcttaaagataactgttgctcaatttcattattatccaccttaaagtgatcatctttgtcggcctttagttcacaaccaaaaagatagttttggggcctcagaggactcatgtccatcatcgtccatcaggtggcaggacgcacttaggtgggagagaaggcagatgatgataaaggaccactgctcaagagaacagctgtgcaggacagaatcacaccagggagattacctttatcttagaaaacctgaacatcttgtgtactttgacacttctctacatttcacctaacctttaacatcaacacatttattcagaaaacttttacttttggagctgctctgtgtcaggctctatgctaggtgctcaggatattgaaattgatacaatcctaacctattcacatataatccaaggtttgctgaaattgatggacatttaaacaattgaaacatttaagtggtataattagcaaatggacatttaagccataaaaatagcatctaatagatataatagaggtcggtacaccattgatgagtcagagcagaggcaacccaaagagtaactagccagaagaattgggaaagcttcatagagagagcgatatgaaaataagggagagaattgtaaatccatgaaaatgagaaaaagttgaaaagtgatggtgtcagaaaaacttgtggtatgataatgacaagatgagaggaactcttggtaagcgtgttggatgcatggaaagaaatggcacaaaataatgctgaggacattttttattttattgttggttttgttttggttaatttcattttttaaatctagtatgctagtgttcattgtccaaactgtgaatcataaactcagtttgtggatcaacaccggcctttgatttttagtgaaacaaaatagaaaatatcagcattcatcacaaatagatgtttcacagattttttgttttaattgcgactgtgtgtgtgtgggtgtgtgtgtgtgtgtgtgtgtgtgtgtgtgtatgtgagagagagagagagagagagagagagagatggcttggatgtttatcacctccgaatcttatattgaaatgtgatttccaatgttggaggcagggcctggtaggtgtgattggatcatgtgggtggatccttcatgaatgatccctttggtgacaagttagttcatgctatatgtggttgtttaaaagagtatgagacctcaacccccacctgtttcctgctctcccctttgccttccaccatggttggttgtaaacttcctgaggctctcaccagaagtagatgccagtgacatgcttcctgtacagcctgcagaaccgtaagtcaaaagaaaaccccttttctttttaaagcacccagtttcaggtatttctttatagcaatgcaagaagggactaacacagttgtatgtgtatgtgtgtgttgggtgatttctggttgagtgtcacaaggttgtaatatggtgagtgtaaggaagtataagttttagaaaattaagaagccagttcagaaaactaatacttttggaaaatagtacaaaatcaactttacaagaatatacacagaaagatgtaatacaagatttatttcattgcagtaatttataaagttggtttagtgccttgcttttgcatgctgttttaaaaattaccaagaatatgacttcatgtgattttgaaatactcccagcaagataggtagaaaaggtattcttataactcttagacaaaaatttcggaaagtttaaacgctttatcccaaatcataaagctaataaatgaagaatctgggattcaaacaccatattttttttactgttcatcagctagaagttagaaatgttaagccaaaaacattaagtcactgctctgcctaataaatcttgaggaaactaataaaaagaataataccactgactacaggacaaggtcttcctaagagaccttaaatatattaagtgatgaagatgaaacttcttttattcataaaaatgttatttagttatgagtagagctctaattaaacttattttatattgtcatcagtaaagttgagacataacatatttattaatataattataatttgacccatagtgtattaaaagaaggatgttaaaaggagttgttattagagatgatgttagggttgttgatgataataacagtagtcataacataacaaagcacttcataatttaagaagtgccttcaattacattgttactctcatggtaatctctgtttgatatatagatttggcggattctatatcactctaagacataggttactgaggtgacggaggaatttagcaagcggctgtcaaatggaggacatgagcattggattgtgtatggcaagggctgatggtctctaagaaagcctcttggtttccacagggcagaagccctttgaagatcatagccaaggatttagtaattgcctccctttcagaataccctcaagagaaaagcccaccataagacatggttccctacaggcaaaactgcttttccttaaaatttactgttccctgaatatcagccttctttggctcattcaacatagttttcttaagtttcaggacagtgctgcagaccaaaagtttcaacattgaggaaaacaatactacttgtgcagtgaccctacctcagtcagggaggcagatgcctgcctttatgtgagggaataaggaatcaatcatatttccagcactcaagaaagccagtctagtgcagggagagatagatacataaacctcaaagttatgatatagcataatagttttaaatttccataataactgtattttaaaagttttatagaaacagaagagatgacctcagtctggaaaagccagcttggagaatggcaaccaatattaagtggcaaaagctttgggatcccaggcctccagatggagggtgatagcatgggccagacaggtaggttaggaaaactttgcaaaggacattacacggtacacagacaagtctgtgttttagcctataaaccacagttgcagaatgtgtttgagcaaaggcttttggggatgagatttgcacttttcaagatttaagtttgtttaggatacttacggtttgctgtatacttcctgggtttttacattataattacggtttgaactttaaaggaaaactgcagtttagcatacttgaaagagtgcaacttcaagtcatgattggagacagatatttaacagattttgtgatcctgtgatgcttattttcttctcagacataccacatgacaatcatttttaaacagtttatttctactttagcatccatctgaaggtgttgtgtatgttttctgcttgaaaataaagcagtgggctgggtgcggtggctcacgcctgtaatcccagcactttgggaggccgaggcaggcagatcactaggtcaagaaatcgagaccatcctggccaacatggcgaaaccccatctctactaaaaatatgaaaattagccaggcgtggtggtgcatgcctagagtcccagctacttgggaggctgaggcaggagtatcgcttgaacccgagaggcggaggtcgcagtgagccaagatcgtgccactgcactccagcctggcgacagagtgagactctgtctcaaaagaaataaaaaagaaaataaagcagtgaatgcgattaagatggatttattatgatcataaagtactcaggagtcttattttaaaagacagcattactgtaattaaaaatatagggaagaaactaatgctgttttgcgtatcattctcagctctctcaaaatcagatattaagctcttgctgccaaaggagactatactgcacggtgctcacctgcataaactttgagagggttgaattgtgccaagcaattctctcaatacataaattaaccaaatatttgttgacctactgtgtgacaagtattattccaggaaataagagatccagcaatgaaacaagtatggcttcttatagagttcccaaaaaggaaataaaaggatatacgtatagtgatatccctgaattaaatttctcttttgaaaataaaaattctatcataagctgtaactgccaacacttcaatactcattcagcagttttcagggatttgtaccttttgacttatgagaatttggaagtctaattgtatcattgcactggagtcttaaagaaacagataagcgaatgactttgcctgtatcattgttgactgtacttacaatcagaaaggggcacaggacagatgccagggagtaagtggacagcccataaatggaatggtaagaaagaagaactatagtggatttggaaagttcccttcagcattttccctagacaatctttggctgtgtttgcatgatcagtatttcattcacaggatattgagctcttgatatagttctcaaaacccaaaatgaaataagaagtctactctttatttaaattcaaattccagagagttaagtaactttccaggaggtaatctaaatatggcctccttgttggggggggggggggtgtttgaatttgcatataaatagtctcacccttaaaggaaaaccacagatggtggtaatgatgtagtcataatgtacatctccacagtggtggaacaaaatatccacagttttgctttccccagtttcagtgacccatggtcaactgctgtctgaaaataggtgactacaatacaataagatattttaagagagagaaagaaagatcacattcacatgattttcattacaatgtattgttataattgttctatttttattcatgatttttaatctcttaactgcgccaaatttataaattaaaatttatcacaagtacatatagtttatatagggctcagtactatctgcagtttcagacatccactgggagtcttggaatgtatcccctacagataaggggtaaaccactgtatcctatttgtgtgaatgctacaggtgttgtgagctcataacaatatgacatcaacactgaactaatccaggatttggtagtgagagtgatgtatttgcaaggagtgagacgtggtgcctcatccaagcagagaaataattttgaaatttgcctgacaataaaaatcacaatgtgaggtctctctttagagctgcaaagtccaattcagtgccccctagccacataagatactgagctcttaaaatgcggctagtactaattgagatgggcactgagtataacacacatgccagggtttgaatacttagaaccaaaaaggaagtaaatgctcatttattgcatgttaaaattatggttttattatagttgattaaataaaatatataattaaattgacttcattttgcttttaaaaatgtggctatgaaaaatttcaaattatatatgtgtgtgattacatatgtgtgttttcacatatgtaactgatgttacatgtgaaattgattgttacatgtgacatgtaaaacacgttacctaacacgtgcatatgtatgcaacacatatgtaacgtgttacatatataacacgttacatatgtattgttacatgtgtgcttgcattacacacatgcataatatgaaattacatgtaatttcaaattacatgtgtatattttgaaaattacaaattacgtattttgttatttttgctttacaaagtcaaatttaccctatttaataaagcatcatgagttttttataactagtaaactttgagacttttgtaggagaataaataatgcttattataaaaactgattggaaaagtgagctggagcagggagcggaggaaaaaggactagagatcacctttcttcccagctccgctcctctcccaaccttttttctttccattctctcatcccaattcaaaagtgcagagttcacagttggtgtgctgatttagaaaacagatatataaacagccttaaattttctccaggcttttacaatgaaaagaagttcaatatcaaaagtaacaatataatctgtggaaaggtatagggggctatgtttttgaggtagaaactataggtgctcctggccaagcatggtggttcaagcctgtaatcccagcactttgggaagctggggcgagagtattgcttgagcccagaagtttgagtctagcctggcctacagggtgaaactccacctctactaaaaatacacacacacacacacacacacacacacacacacacacacacacacaaaagccttgcgtggtggcgcttgctgatagtcccagctactcaggaggctgaggcgggaagattgcttgaacctgggagacagaggttgcagtgagctgagatagcaccactgcactccgacctgggtgacagagtaagactgtctcaaaaaaaaaagaaaagaaagaaagtataggcactccttatatgcagctgctcacacccctcctccttcacacccctcccccttcacacccctcccccttccccaaaatttgcaaggggaaaaatgtgtgtaattggcagtatttagtggcgtgcaaccgtgagtcatcagactgcacatcctcacttctgctagtggctcagtacccaacagcactcagtgaaaactaactcatttcaaaggtgaaaacaagtgagtttggccaccagggagtgttcaaaactgtcagtgctgaagcaaatgtggagggtgttctgtagtttgttcaggttgatatttgtggtccaacccctagctgaactactaattattaatatctgtcttgatggtgcctcaggagaaagcttctcaaagggaatcaatgttcaaattatagtaggtatcttggccatggaagttattgaattttagccaatacttgctactctttcatttatagtgtgagaatgcagtgtaatgaacctgactctcactgtcctgacttgcctttctcatcgcattcacaataagcacgtcaatacgtatacacatttcatatttctaaagtttactttatttccttattgtacatcgctgtgctgctgatggaagagaaaaggaaaaacactattgattgcaaaactgttttatctttggtggcttagattttttttgtatgatatgtaacgtcttgcatacctaaggcaacacgaagctaaatagatttgcatatagcatgtattttttccaattaaatgtttaattttgttcagagtatactggggacattttgaataatggagaaaagtacaaagaaaattcataattctaccacctatcagcacagtgaaattttatgaagaaacataattttcatgtaaatcatagtgaactcacggtaggttttatttaatacagtaattggagagctggtaggaagacaaaactggttcaaaagagaatacaagaaacaaatgcttctataatgagtgaatttttaaaaaagtattctggaataagattagtgaataagatactaaactcgttgataccctacagcctttggggttatatcctctactgggtaaaaagtcatttacatcatatcagttttctaaaatttgcattgaacttcatagcgttgtaacatgtgtgggcccaaattaatagtaaacagtaagagttgctttactctgaaaatattgaagctcttgtgagggtgtgaggagtttgttagaaaacaacgctaccattattttgaaacacacacgatcatcttttgttttacttctaagttttggataatttttcttaaattatcttattatcttatccattttcttaatttccttaaccttttaaatgtttctcctaggcacttttattgatttttggaatatagttgatatgtgctgaatttttatcatccagttttaattctactgaaaaatctaaaagatgttcatcaactactatatttcaaatgcatacatcccctttcatgctaaagaaactgtatgggaaacacagtctgacattttcaggacctggtatcattaaaagtcttgacactgttaaaattaaacaacgccttttttaaaatcaaaggatacaaaagggctgtgttggtcagaggatacaaaatttcagttagataggagacataagttcatgagatcttttgtacgacatagtgactataattaataataatatgttttcgaaaattactaagagagtcgattttaagtgttctcaccgcaaaaaaatagtatgtgaggtaatgcatatgttaattagctcattttagctagtccacatttttcaatacaatgtgttgtataatacgtgatatatacaacttatattttccaattccaataagtaaaaataaatgtaaattatttgaaataaataaaatgtgaagaacatccacttttcatatgaaaccatgagatattttctgttaaaagattaaatgtccaataaatttttgatgttaacagaaacaaaaatgtttaatatttaaatacatatttgcatgctattgaccccctgaagttcactgctgggctaagtgaaccaactatatcttaagtcaaaaatgctgaaattcttccccaaatcccaaagctcatgaaaacataaacagaaaatttccaaataattctacagggaaaataagacacactatttgatctgatcaaacaacgggatgattatggttaataatgagttacttgtacatttaaaaataactaaaggagtgtgattggattgtttgtaacacaaaggagaaatgcttgaagggatggataccccgttctccatgatgtgattattacccattgcctgcctgtgtcaaaacatctcatgtaccctacaaatatatactcctacgatgtacccacaaaaattaaaataaaaaagagagggacccgaagataagctaatatttaagctcatcatacttattaagataagcaatacataccgaaagtaatagcatttaaaaccagatgttgggggagggttctaacttgttcattaaaattcaaagtcacctgtcttgttttttcttttgtttttgtttttttttttttttttttgagatggagtctcgctctgtcaccccaggctggagtacagtggcgcgatcttggctcactgcaagctctgcctcccgggtttacgccattctcctgcctcagcctcccgagtagctggtactacaggcgctggctaccacgccccgctaatttttttgtatttttagtagagacggggtttcaccgtgttagccaggatggtctcgatctcctgacctcgtgatctgcccaccttggcctcccaaagtgctgggattacaggcgtgagccaccgtgccaggccacctgtcttgttttatcatgatcccgagagtatatatgtatgtgtacagctcatctaaaccctttttctttcaacatgatcaatagattgaacattggagatattttataagaaataatgaagacaactcaatcagcacatatatatattaaatgtggaatctataatgattgcgaagcctgaagcaaactaaatattcagtaataggttctttttttccatggtatatccatttgaatatataacataaatgccttacatttgttttaactatttaaggtttatgttgttagtgtgatgaaatggctggcaaaagtcagaaactcaggaaagtttcaggcttatatctggagcctggttttctttcttcaaggtagaacctctgtgaagtgaaaaattttttttatatctggagcaataatgtagaagcttaaatgtattatccaagttgtcataagcctattatttctttacattactgaagtgaaagacagcattaatggctaaatgccatacttggctataatttatattgtttaggactggaaatgagcctgaaatgtacatttttttccaaaatagttcatgtaatatttgaaacctgacaagtaacctgatgatttcatggaataccatcaaatataaatgtgaagttttaaagacacagggaaatactcagaataaaccccctaaccacaggccagcagaagaactagacttgagaaaatgaatgggaagatagatagtaacaaatgacttctttggcagccttatatatgcttagtcttatagactgttttatggatgctctgcactctatttccagcaagtatggcatttggaacaggaccacacgagacaaactatgagttcacatttcccacaactgcacagatagaaagagggaacaacagaatactccctttcttcttgaaacaataacttctgttgaagctcactggcttcttttcagctgtttctgctagctcctcctccgcctcttgacctctaaggcaatgctcttcaaaatttcaagactgctttctaattgaaacaaaacttataagcacatttcttcccacaaaatgtacatttatttgtaaatcatatatgaatatgactaagcatgtaaacgtatgtgaaaatagaaatcaataaatataaatgcaaacacaaatagaagcattcacagttttcttttgtgtcccagtgagttgttccaaattcctcggaggtaggtatgtcacagtttgagactataccttcaatcctagggtttctggtttcgctctcctcctaggtgatagcatccatttctacggacttaactgccatctttagttgaataactcctctatctttccatcccatatttctcttgattccaaacctgcttgttcacctgagcatatgacacaattcattggctgccgcacatgcagctttgacattttatttaaaatctttccccttccccagccctcatctatttcacagtagtatcttcttcttatctacttgattggtaagcagagtccacatgattccatcatttatctcccattttatatctaatctataagcaagtaatgcaatgcaacttctgtctccaaaaatttattttgaatttgccttctcttcctctgcatctcccccatcttaggccaggtcacctctgccctcttgccagattaggtcacattctcttactactgttgttattctcttcctattcaatcctacaccgcagcaaaatggatcttctcaaaatgtcagctagataaaggcatttctgtgcttaaggccctcatggatttatcttattaggatgaacacccaactctttattatggcttagaatacaatgaattacaacacataatgaatatattatatttctatctttaccattttcttcttaagtcaacctttctcaatccatataggataatcatattagtgcttcctcactttctaaaacatctcagggcctttgcacgtgtttctctgttcttagacccagaatgctcttccttttctctttgtgtagctaggtgcttctttccatttacgtatcacatgaaatgcagtcattccctcctccttccctcactacctcacaaaaagttgatgcctctgttaaaccatgaatggaattttactcggcagtgaatagaggaaaaaccaatggtaaaagcaaccatatgaatgaatgaatgtcaaaaatattatgctgagccaaaagtcatagacacaaatatgggtatttacatgaagttaaagcacagcaaaactcaattacggtaatagaattaagaaagtggttacctctgggtgagggttggaattgagtggacagaggcattagtgactttttcggggtaatggaaatgttgtctattttgttcaggtggtgaatacatagatacattcaattgtcaaaacacatccatccaaacacttagacttttgcactttattatatgcaaattatgcctcaactgaaaaaagtttgttttcaaaattatatcaacagttgaaattcttttaaagatttgattcaaatgagattaattctgtatccatcattgatgtatgatagttttgtatgtagttaaggttattggagataattgaaagttatactcacaagaaggctgcataatatgaagtttatctgccttgatctttaatagctttcgcgatttcaacttcttcacagctctgtaagaaggcagtgtggcatgttgaagcaagcatgtgttttagagtaacacagagctggtatacaaccccatgtctaccaattatcaatgatgtgggtatgttgctggatctcaataatcttccactgtgaaatggaatgtaacacctgactcacaacgcaaaggtatttaccttatgtaatataattcctgcgatcctgggacctcccttaatcccatccacagatgccaggttaaagaccccatcacagactagaacaagttgggatgtcaaaatgaataaatattaatcgaagggcctattgtgattgaacaccacgcagtaggcactctctaatacctaccgtctccctcctttttgggggaaacattctaaatgtgcaaaaaataaagggttatttgctttctggcacttgggatcgatttattgaggatatgttagcagaacagcaaaggtgaaacactaaaagcaccatcaatacacaggcagaggtgaagccataaagcctttattttttaaattaatgcacaatatataagaggtatgttagaatgaacgtccaatccctgaaaggatatacgaaagacattcataaaattacatgggcatgttttcttaatgttcaaaatattgttttaattagtgtattatgagtttattcatgtgtctgtgtgttgtgttatattaatcttttcttgcattgctataaagaaatacctgagactgggtaatggatgagaaaagacacttacttggctcacagttctgcaggctgtaccggaagcatagcagcatctccttctgtggaggcttcgggaagcttccagtcgtggcagaaggcagaacgggagcaggcacttcacctggctagagcaggagcaagagagacagaatgaagtaccacacacgtgtaaacagccagatctcagagaactcactcatcatcatgaggatggcaccaagaggatggtgttaaaccattcatgagaaatccacacacatgatccagtcacctcccaccaggccccacctccaacactgggaattacatttcaagatgagatttgggcggggacacatatccaaatgatatccatgtttaatcagaaaaataaaagttaacagtaacagtgattttactttgtagacctttgctaatggctgaaatctagctccattccgagaacagcctgcggtacacattttgaaagatagttgattaatatgaaagaagccttatctgtagtccttaaggccattatggtttacatatatgagtaaatattccaaagtagccatgccagttaacatatatccagagtctaaaggccactgggcgacaaaagtaaaagatacatagcaattgttactttatatcacagtaattcttgtatattttaaatggatatttgcatttgaggatatccacttaagagttaggtacatggctcttacatttaagtaacatttacttaaatttctggctgcagcaattccacataggtagaaatgaagtctgaattgagttgggggtctttgcagtgctctctctgttcattggctattttgacaatgctgagagatgtggttagccattctttttcatttcatattggcaacctagagagcaattaagccttctccccttaactagatgtatgttttactcatttctggatctttatggctgactttgaatcctagcctgtggtagaaagcatggtgtcagaaggaactatgagttaagactatgcatacttggctttgagtcttgggtatcatacctccctcatagagtgaaggaaccagggattcttcttgaggcccagacccggcatccatgttaagaatacctgtgcaattttgcttcctgatatttaaggtgaaaatgcatgtttgggtcattgtgaggattatgtgagatgttacttttaaatataggcccccttattatatgctctcatagtttcaggcaacacttgtcgtatttgtaacctcagttttaactgtaatgtttccatcaatgtccctcttacctggtacaggggctcttcatattcttggattacaaatctgtgaatgcaaccatgcatcaaaaatattcagaaaaacaatgaatgcctacctctgtactgatgatttataggtgtttttcttgtcattattccctaaacagtacaatgtaataagtatttatatagcatttacattgtattaagtattataagtaatctagagatgttttaaagtatataggaggatgtgtgtaggttgtatggaaatagtatgtcattttatatgtcacttgaacatttgtggatttgctatccgtggggatcctggaaccaatcccccatggatactgagggacaattgtattataagcagcaagagggaaaggaatctgtctattttgcccaaaatcgtgttcccgggacctagcatagctcctggcaaagagtatacaacaaatatgcattgaggagagaacagagggaaccattatccccttattctcgctgttccttcatgtaatgaataaacagtcaaatcttacaagagattttaaaccagtcagagaaaagttggaagttagttagttgttcatacattgagaagcctcgacgctgtgtcatctaggtaatgaaagatctagggaagtttagcagggagaagaagagagatgatagttgtcttcaaatgtttgaaggactgttacggacacaaaaatttaaacttgtgctgaataattccaagaggtacacagtctctcgatagaagctaaagtggggggtgacatttgactcaacaaaaagccatctaaatatcagaactttcaaaagcaggaactggtgcctcaattaatagtgtgttttctagcacttatgatacctgatcataggcaagataatgaaaaattgggacctgggagttatacatgggaatttgtttatcagttgggtgattaggagaggtggccttaaagtcctgttgtgttctaagagtctgtgattctgagtcttatttcccaacaagagaggtacagagcagaagatgggattgggagaaataggataaagataccaggaaatcctaaaggtaagaaaaggaaggcagacctgaagctaactctatacttcaggtgcttgcctagagccagccctacctacttagagaatgttgaagagccagttaaaacatctttaacacggatgtaaaacaaaactatcaaaacctgaagatttcgaatgttctaacctactcgtcagttgggcttttttcacaaatacttcagtaaataggcataaatttattttttaatgatagaaaatatctcttaaagaacttataactgtggataaaagcaccaccataaaaatcttgtggtgaaatatatatatatatatatatatatatatatatataaaattttaaatatggttagctagaatatgacgacaatgtttatgaaacacagagactcttgacaagtcccatgtatacactataaaactttaagttatccactattcactcactaagcttatacttaatgagtgtctgctgtgtcacttattgcggaaggcacaggcggtatagcattgcacaaaacatatgtggtctctgatggagtttttcagtctagtggtgaaagcagtgaatgggtgtacagatgttaaataattgtacaattagttgcatgtgtaaacgtcaaagttcagaagatgacaattgatctacggcaatgtttctcaatctctgacgttttgagccaaatacatctttgttgtggtggactgccctgtccactataggatgtttggcatcacaactgacctctgcccattagatgccaatagtactctcttctttaatcacaaatttgtcccagacatttccaaatgtcccttggggagcaaaatcatccctagttgaaaatcactggtctagggggaggtctttatgaggaagtaacatctaagaaagctggtatgtttacatatagctacagtctattacacatgtatacatatgtaacaagcctgcatgttgtgcacatgtaccctagaacttaaagtataataaaaaaaatgtaacaaaacaatacagtatgataagtgctatgggaccaaagatgaaagggttctactgcacagttatgaactcatagttaggcttttggggtcaaaattttgctgaagatatttgccacccacgtgacctttggcaggtgacttagcttattcatgcctcagttttatccaatgtgaaatggggctggaaagtcccatgtacttcctaataactttgcggaaataatatgtggttatataggaaaaaaaaaaaaatcctagaagtatgcctgctgcgtagtaaaaggaaggagaaggataaagagaaatctgcattttttcttctgtaatggggcagatagtaaatattttaagttttgtggcccaaatagtctctgtcacatttacttgattctgcagttgtggcattggaagcagctatggacaatacttaaattagtaggtgtgcctgtgctttcaataaaattttataaatacaaagtttgcaaaacaaagttgttttttttttttttgtagtttgctgacaccctagtaaagaagcaccattgtcaacgttaaaaattatcaaatttttatttttcaaagttttcaaatttgctttgcttggtctagctcatgaaataagtcaaaagtagcaagacctccacctctaaaataataatagtaatgataacctcaaaaggaaagaagaaatatttttaaagaagaaaaattattgttaaataggattattgtgcagagaaaacctaggagactcaattttaaaatctgtgaaataattttaaaaatactttatgaatagatacataatagcttttattcatattaatgactataaatgcaaatggaaatatttcattcacactgatgacaatgtataaattaaggaggaataaaaattgtagaccctataggtgaaaagcataaaaatatacataagaaaaagcaaaaattgactacgtaggattgttttaggatttaagatttattgtcattaaacttgcaataccagccaagttaacatttgaatttaatacagttataatcagaatgcttttgatgtgtttgggggcaatataatttcaaaggaaataggcaatgatgtaatttaaagtttatatagaaggaaattgtgtgcgtgtatgtgtgtgtataaattggaaacaattttattaataagcatattatggcagcaacatacacttccagatttctactatactttgaagtaattgtgatcaaaaccacagtgtgctggcataaggctagagaaatgggttagtggtttacaagtgagagtccaggaaaacatccaaataagattggatattttagttctgtgtggatagcctatttcacttaataaatagtgtctcgtaattgactattcatgtacctataagtttaactatagaccaaaaaaacgccctactagattaaggagctaactagaaatataaattcatataaacaataaaggaaagtgtaggactttataagcttcatgggagacagatttttggtaagtcaggaagcctggaagacttaaaacataaaattggcagactgaattaactgatagtttaaagcttccatagagcaaaataaatcataaaccaagttttaaaatatataatggatttagagaaggtatttacaaaaatatatgactaatggaggttaataataacaatatgtaagaaggatatgaaatggcattttactataaaggtcaaacaaatgacctataagcataataaatcatattaatctccactagtaataactacacacatctacataatatagatgttacgcctgcatttgatttactttatctgtcttttggcagaactatttgtcaccagataaaaaattctatatcattaccagaaaggtatattattataatgtttattatgttgcagttgtaaaagaaataacagcttttcaattgtttacaaatcctatagaacatttactgaaatacatttacattttgtggcaaacttggatttaaataccgtgttcgtgctttgttttatgccgttttcccatcttttctccaggaatttgattgtgcttcattgaaagctaaaaagaaaaaaaaaataattctggttttggtttaaaaaattaggttaggggttaaaaagttgtacgttgtcttctgtaaaaataaaaaacaagttttctttgtttcttggaggctttatattaaatggatttttaattcatagacagcatattgtgatgaaatttccccatgagcttcacattttgtttcaatagcagaaactaacttggttgcagttactgcccttctgagaacagtgttctggaataattttgacatacatatgtatctctttttaaaacatgtgttaatcttttcataaagaaagttttcccagctgtgtcacctgtgactccaactttctggggggacagggatatgagatgttggaagggaatggcttgaagaaataaagtgcaaaagacgtaatgctttcctgtggtagaaatgtattcagtgaccctgaatgaccttcctactcttgtcccttcatttttcccacaagtatggtctgggcaattataaaaattgacatttgcagtgggctcttctgtaaaagatgctcaatcagaaatgatttattttagaaaaagagatgatataaacatatatatcccctgtctcggaagtgtgaaggttgaaaagcaaggagatgatcttcaaagtgtctaaaatattgatttgtaacatcgttttatgaaagtgcttcagattattttttttcttggatggccccttatgctttggtcagttgatgctaaaatctgaacttctttattttaaaaaaaacttttaattttgaaaaaggaagttcacggtgctgtctaattctttttagatagtcattaatgtaaatgtaagagtcattctgagaaccacatctgctgatatgttccgttaaattacaagttctatgtgtatttgctttgctttcatacaatgaatcttctttactctcttccccacctgccagaaattgccccactcaacgttcataaaaggtccattttcaatcgctatatttatttcagaagcagagatatcatatattcaaattttagttactttccaatatcaagctaataactcacacaaataaatcaaactacagcaaaacagcaatctagcattcaacaaaacctccccaatgcacatatttcaagctgtagatatgtatcatccaccatgctgaaataatgtacatgttcaaatcaaatggaaaactagaatcaaaattgttgattacttcttatcagggcattttattatatttaagaaaaatacaaattaaatcattttcaggaagcaatccttctggctaagatttttttagcataatgcttaaagttaattgttgatctttatctataaattcaaaggtggactaaaaatgcagaatcaatcaggtagtccattttgcatcaggtgaaatatataaagcataaaacagcgagttacatttcctaacaaaattgaattacagtgagtaaaagtgacaggacaaatgcattaagaaaagatggactgaaatggatagagtagaatatatgcatctataaaacacagtcatatataatacactcattttttttcttacgagtgtgagattaatggaagaaaacaacaataataacaaaaccagtgtgatgtgtcagatttcaccttttaattaaaaaattattcacttcagaggggaattttctttcttgggttagctcaatcatgtcagatcttgttcatttaaaaggtcagtttacttgccttctgaggtttttgtttgggaaaaagaaaagaaaatagattttcattggtatcctgggtagaattaattgtttatcattcatttttaagatctccgagaggcagaaaaaggggaactgtgcaacccttttgtccttctggatctcaaaatgaagggatacattctgctacatgaaatgtggaattaagaccatgatgcaacatgataaacaacacaaatttgggggtgtctctgtgctatacattattgaatttttccatgctatacactttttggatgtgtctgtgctatttattcagtttttttaaataaaagtttttgtagactaaattgccctctctactttgcatcgtttttgaacaaaggattttcaagactgataagctcaaatgtatcatttattgtattcaagtagcattcaatttttctttagaagtataatttgtagatattttaacacagaaaacttgcaacactgctcatgataggcacttattatatattttttgaaagactatatggataatgattctaactttgacttttcctgttttgccttcactttagaattaagcagagaatcaaatccatattcctgggggcgatgcttggacaacagtatctctttaaagatctttgtgtgagtcgaaggtgcagccagactgggagttattgtgaagaaacagattcaggaaggttgagaaacttgcctaaggctaatcagatagttactggcaatgttgtttctaaatcactgtttggctccctcattcaatgaatctacactatgtgggactgcctcttgctcctgacatcttttgctgctgaaataaatgaactcaaagcctagaaggtagaaaagagggagttcagaattatattcaggcacaaataccaataaggctattgcccccagaactgcaacttctcttggtttaacagataactatttagctgtgaggtacaactgaggaagtggacacacaagttatcaggagattctgatgtgccagtttatatttcttgtcacaggtaatgattcgaaatttcttaaaacagctgtcctcacagtggagtaacctgggagtacatgaaggcattccaaggagtaggcacagatagttttaagggaatttatttctagatcttctactttattttgtactcttcctgaaaactgaattgcctgaaaaaaaaaaaaaaaaaaaaaagacatctgtagtcaagacctcaggctgtttctcctttctaaccacttgccttttctaaccacttctcccaatttaagaaaaaaagccttatatttcatccaactctgatcttactaaggcttcaaacaaaagaagcatgaatgactttcatgacagggcaacatagctttttgcaagaagagtggttgctaactctttgctttcaactgaacccgaagagaagacctgataagttgtcagccgatagatcattaaaaatacgttttggtaagcaatcatcatgtacttttagcatatgccatagcaggagcacaaatgattaagcaatgctactataatacaattccttccgtttctttctactcacctatttgaataagatttttcatcatttacatctatacagacaaaaattagggatagaattgatgctgaagcctttccaattgtagaattaatttatattcttctgaaggtgtataaattgttaaatacccatccatcttattaagagatgtattttcaataaaattttatttttatgtttatcaaattttataatatacatatattgttttggtcaattgcacgttaataattgtaacaatacctcaattgaaaaggtttgttttttacatttaggacttacagtaacagaaaaaaaacactcattgtgtatacatactgtttaagaaaagtatactaggtgatcaataagattttttcaggcataaacatatatcttagttttaagatatcgatatttacaatgtccctcaaattatattattttcagtcatttaagaatgaaaagtacatttcgaatgcggattttaaatctgcaagggttgactcatttttcaagagtctttttaggggatacagaagcaagaatgtttggagttccctgatcagtatctttaagagaaggtatttgttggtagttcctagcaaattccaacagcctgatgctacttaaaagataatagtaattattttaaataatgcttctgataaaaaacattcatgcacactcagtttaaaaagatatttaaacatttgtagttgtagtttgggaactcatgatacaagtacagtctgtaaatgaagctcttagtttgcaaatatcagagataagctattaaaatgcagaaattgaaattgccctgatatatgcataaattagtgtcatctccatcttgtcagttagagtattttttagattctctctatgtatacatacatatatatatatatatatttatatatatatatatatttgtgtagctgtgcatgtgtgtatttggactaatgggtcaaaggacagtactaacccaattcaataattaaagaaaacataattttgagaattagctttatggtaattgtttgacttaaatgagtagatcagagaagaataagggctttcccttatttaaacaagcttcatttttttatccaaacatttacttagctgattaagcttcacttgtttattttcttcaaagcattcattcaggtgggtactgagtaaactgaaatatcacaccagggaacttcaacaccatccaagtcttaaaggcttcacttgttcacagttggcatttagtgaatgtctaggctactgataatattgtgagtaagttggcagggatcataagaaatgataaaatacagttcttgaaaatgttatggtttgaggaaaagatctatgtttggaattagactgacttggattcaaactctggctgtacctttgggacaaggtgttcagaaactctagcctatgttttttttctgcaaaatgatcctcttttccaggattcctgtagagattcaaagatatgtgaatgtttagaaaaagaatagacttttgatcattgttaattcccttactttccccaattagacttgtaagactgggaagaaagctacacaaaagattgaacaaattatagctgacagaccatagcaaaagatacagggcaaaacttaaaggggaaaactacacattaaattattttaaaccattaaatagcactaacttttgtcagatattacaaccaaacaccactcaaattaaagtaaactgaataaaatgcctgtttttttctgtttactgatgttttcatttgcttcattcatttattggaagatataaaatgtgttagacactgttaggtgctgagtgtataaaaaaatcttattaatacaatttaaacacgcacacacatatatatggttataacaattgatgccatgtatgtactgtttatatgcctatacattattccacagacctggggggagggggatgtagagtcttaccagaaccataggaatcttctcacatcaacatttccttttgaagtttgttcatgaggcaccatccagataatactaccatctgcaatgtggcttgagaagatgttagatttttttattacacataataaggctgtaaagtatttctgtatttaggtagaggtatgtaatacaatatgtatataaaattacatatccaataaaatctggtgttaaataaggactagcttctatgataatatagtctaaaggcttttcatttggtgttatagaaattatgtgaaatatgtttcctggagtagaattattcgcatttcagctctctgacagtggaagaaaagctagagggagaggtgaacaagagagggagcataatggacaaagctttgctggaagccaaaccaccacttcatatgtcaaatctgacaggcctcccattttaggtgtgctgtcattgaagctttcagctgcaccttgcctgtggctaggctattttcaaagattaaaatgcgaaactggaaattaaatgcaacttaattcccaatttaaatttccattatttttgaaaagtaaaagattaaaagaaatgtataattgcaattctggtggaagaggtaattataggaaaggtgggatgtatttcaagtgggggatatagcttactgcagcagagaggaatctaagctatcattcttttgaaattggtctggaaatatgttttcacatggaaaatatactatatttttaggaatttccttgtcatattactgtatccttttctgttagaatataaattctgaattccctattccactgtagatctgcctccgattatattagctcttctgaagttatcaaaaaataatgagatatacaatattccatatatgtcaaagcaattatttttaggttaagtaataaaccaatgacctttaacccggtaatattctgggttgttcataaaaaaactatattcaggtaataatgtctttccacttaagcaactgaaaaaatacacaatacttaacatttggttaattaaatacctactccagacaaaaggattttctgttttcaagttatcttagcaagctgagcaggaagcaatgatatatccaatcagaatatccatggaagctctgctacagtttcaaaaagttctcatcaggcagcttttaaaatgcctactctgaaaatggtccaggttaaagaacaacagcttcctcgtcagatagcagtattgcttggccatgtttcttcctagcacaaaaaagtacctgctcttctctgagtacctacattctaaggactatggcttacataaaacagcatgggttggggcaatttccagcacactgctcactctcgaaaacgtatgatgcaggtgagagtaatgtttttgtttgaatctgctttcactcgtggaagatgaaactacttgcaaagatctgtactttagctattatgagtaacaaaagactcctaaaatattgcacacattgtggggatggagaaccatcatcctgggatttgatggatcctatggtttggctttgtgtccccacccaaatctcattttgaattgtaatccccacaatccccacatgtcaagggagagagaccaggtggaggtaactgaatcatgggagcaatttctcccatgctgttctcctgatagtgagtgagttctcacaagatctgattgttttataaggggctcttcctgcttcactgggcacttcttcctgccacctgtgaagaaggtggcttgctccttctcaccttatgccacgatggtaagtttcctgaggcctccccagccatgctgaactgtgtgtcaattaaacctctttcttttataaattacccagtctcaggcagttctttatagcagtatgaaaatggactaatagagacgtgtctctcagaagtcacagtgatgcttgaacggatccagagctccttcttcaggaaggtcccaactcattctgaagggtctctccaagcccacctctctctgtaaatgggaaaggttttactttgagcactaaaacctgccagaattctcaattttcctaacagtgtgttaataaacacctactcatttagtatccaaaccaggtctgtatttctcaattagagctcaccaggctttcatcataaagtagagcttcaaattgtctgcaatcccactcctatcaaaaacctagaaggaggtaatatttcagagtaatactataaccagatgaccacatctaagaaactgctgaccctacgatgtaaccttctgtccatttttccctttggaaagtctaggatcttttcttataccagcaagttacaagcctggactacactaacttgctttccgcagaagaaaacaccatgagttctgttttcatattaagcacttagtctccatcagacatcaatcgagaaaaaatcattaaaaatcacattttatatttgatgtatatttctcaataatcctatgtattagttcattttcctactgctatgaagaaatacccaagactgggtaatttataagtaaaaagaggcttaatggactcacagtctcacatgactagggaggcctcacaatcatggtggaaggtgaaggggtagcaaaggcatggcttacatggtggcaggcaagagcgtgtgcaggaaaattgccctttataaaaccatcagatctcctgagacttattcactgccataaggacagcacaagtatttagctccctcagcacagaaccatccccgtgattcaattacctcccaccaggtcactcccatgacacatggggattatgggagctacaattcaagatgagatttggatggggacacagccaaaccatatcatcctatttggatgatcaatattatcaaggtatgctcccctgagggggcgtcctttttaccatttaactccaggacaaaagtttatttctttgtaaggacagtgtttatttcttatggtcctattttctcctaagatccagacaccaaaatggccatctatcattgacttaactcctgaattttgcttagagtaacagatttagtgaatctaaatattttctggctgtggaatgttaatttatacatgttcaagttacctttgattcatgtgacagtttgtgccaaaacacactcattatcagaactcagatcattatgttggctcttgttttcgttactaaaggaagaaaaacagtttctcaaaaagaaaattctgatacctaggaagaccattatacctcactcttttctttatctcatcaccacatccaatattataaaagaacttacaaagtaaaaagaaaggtgttctgtagatgtagcgcctggcttgtatggtagcttaaatgaacacagctaaaaatattttatggctagtgtccaaaacagtctggcaccagacaaaataagaatatttaaaattatattttagagttactttaagaggaagggagagagagatgtaggcaggaggaggaggagcaggaggagagggagagagagagagagagagagagagagagagagagagagagaatctggggtttctatggaagggctaagaatatgtagaaaacagtttacaaagaaatatggtccaagaatcgtgtgtacacacacacacacacacacacacacacacacaccccctggaatatttttcagccttaaaaagaagaagatctgtcatttgtcccaacatggatggacctggaggaccttatgctaaatgaaataagccagaccaagaaagaaaaatattgtatgatctcacttatatatggaatctttttttaaaaaaggtcaaatatatacagatagtgaattaaacagtggttaccagggtcagggtagttgtgaggaaatggggcaatgtaggtcataggatacaaatgattaaaatatattaatatattaaaagatataatatacatcatgaggactacagttaataatagtgtgtattcaagatttttgataaatgaatagattatagctgttcttgccacagagtgaaaaatgggtaactgtgaaatgatagatatgataatgttctccacaatggtaactattttacactatatatataaatatctatgcatcttacaccattatgtggtatcccttaaatatatacaataaaatttattttacaaacacatattaggaatgcatattctgatttttaacaatagttaacctcattaatatatttcacactatcatttctagtgtacatgaaaagtagtttattgacattagttgtaaaaaaaaaaaaaatggtcttgagacttttgggtcagagaatgttctggccataaggtaggtttctgcttgcctactagatatcttaacttcgatttcctgaacatcccatcacttcagaatctctcaatcctttctaacatccgcaacattgtttttctttctgcatttcttatattgactgatggatttataattcactttctctgaaaaaccctgcagttatcatatatccctatccattctggctctttattgcccaaatctctaccaaaatcctgtcagcacagcctctgaaatatttctcaaagcatttataatctggctctcatcaacattttcaacactctgttttatcattccactattttacatcatttcattttcatttttaccacaatcactcatccaacaaataagtatttagctccctcagtaattagtattattattattaattataactagatgctgagcatacagaagtgaacatgacagacataatcccagcagggatgtcagactttatgcaagtaatcaaccatgatgaatctcatgagattctgagagagagagagagagattgagagagagagagaaaggggaaccactggtgtccgagttagaaatttgaattagtatctgggtcaccaaaagcttctgtgaagaagtgatatagacttggccacacaaaactaccgtgaaggtggtggaaatttttctatgcagagtaccacatttaaagagctaagcctgagagtgtcagagataaaggaacagaaagaatgtgacagcagattatgtttggaagaaagatgttcaagagaccaagctaaagaggagatggggctagaacctggagggtccttcgggtcctgttgggagttttttctctgcccagaagggctttgtcacgtggttgtcaggaaagagtcatgattagagctttgattcagagacttctttcgctgaagtgtggagaatggttcagagagaagcaaatctgaatggacaaaagaggttattattgtaatcttggcaagaagcgatggtggtcttgactaaaatagttctagtgagaatgtgacaacaaacctgagaaaaatacaggagacgtaattgacgggggttagtgttaagttgaacgattgcagagttgaatttgaggaaagtgtcatatatcattcccagtttctgatgtcatacacctctggagataacactgccatttcttttgaaatgggaaaataataagtgatcagtaagtacgtattggataaaataatgaatggttaaatgcataaggggagaggaaaagagttgcagagaaagagagtaaacgtattttggatgtgttaattttgagatacctttgaaaaatccaagtgaggggttgggtagtcagagaaatgaatgtggatgtcaggacgaaaggtgaccgtgatgaactgtatgtcttcctctaagcacgttatacagcttcatgtcacaagtgactcacttcatgtcacaagtgactcacaaggtcacttgtgacaagcatttgcctggtgcttcatccctaacctccctttctatactcagctaaaatgtcacctacaatacttcttccttgactccaccgtccccactttactgatatgaatacattttaataaaatgatataataatgcttagtttgtaaacctaatgttcctcaagtggtataattatctgatttgtatgtgatcatcaacccaaccatattaggagcaccttgaaggtagaagatttaggttcatgcttaacaccacatctggaccactgtggatttaactttctacaatgattgtattcattaatatattgggtgcccactatattccaagtaatatcctgcacactacgtacaaggaagcataggtcccgtgtgctcatgaaactgtaattttagtaagcagggataggatacaaactgagaaaggaaaacaatttagaaagtgggaaatattatgcacagaattaataaaaaagagaaaaatcttgaaaaagtcttcaatacctcacttggaaggtgattttgaagaagaactgatggacaaactagagtcagccatgtaatgatgtaggggcaaagcattccgggcacaagggacagcttatgcaaagaccttaaaaatgaactagctttgtatgttggagaaggataaagagaactaaggtatctataaggtaattaggaagaggatgagttatttagtcccttagtctttgaagcacattatctcatacttcaattgagtttattcttagtgtcattcttctggatgcaatatttgagataaatgtcttaatgaacgttcacctccctccgtagtaatgcctgagtgtcacaaaaactttttttgtttacatacgtagccatctaatggaaacataaaataggaatcaaaagttgagtttcatgtacaaaaggtaaggactgtacatgtggtcataacaacttcaaaagcacctgaaggtaacctttaaggaagatacaaaggctaggaaatatctaggatccatgaagacagacttacttaaggtcatagtgtgtccagagttggttcccgccggtgggttcgtggtctcgctgacttcaagaacgaagccacggacctctgcggtgactgttacagctcttaaaggtggcacgaacccaaacagcgagcagcagcaagatttattgtgaagagcaaaagaacaaagcttccacaacgtggaaggggacccaagcaggttgccgctgctggcttgggtggccagcttttattcccttactgtcccctcccatgttccatttctgtcctatcagagtgcccttttttcaatcctccccacgattggctacttttagaatcctactgattggtgcattttacagagcgctgattggtgcgttttacaatcctcttgtaagacgggaaggttcctgattggtgcgttttacaatcctcttgtaagacagaaaagttccccaagtccccactcgacccagaaagtccagctggcctcacctctcaatagcattaagaatatagtttcacgagcatatatgaatcaaaacttacatttgccaattttatttgcttgtttatgtgtttccaacatgtcttgtcttagggccaaatgtttccctagagaataactattccaactatcttagttgctgtatttttatgcaaccttcaactctccatactaaaatgtctccagaatagaaaataaatcttttcaaagtttcaaaagaggctctctatatattccccttaaaagtaccaggcagacatatttctaggtttctaacattgcgtgttgccaggaagtatatccaaaccatcacaagttattcatgtaaccaagcacacttattggagtgcttctgcttctgttcttgcttgaaattggaagctccttccaggaaaaaaaaaaaatatctatagaaggggaaaaaagtaattttactttgaaaataaaatatacgtgagcaatagttttattctgtttttaatttaccatagcttccaaagacaacattgttttatagtaggggttagcaagtgttttctgtaatgtaaacgtaaagggccagagagtaaatattttaggctttgttttctatactctgttgcaactattcaactctgctgttagaatgttgaagcagtcatagacaatagagaaatgaagatgtgtcattgtgatccaataaaactttatttacaaaaatggcaatgggctagttacggcttgagggctgcagtttgcagactctcacttcagagctaacagttgttgtcaggagtcacttgtttttggaaacctacaatgaggtactataacaccaaaaagagttatcccttcctttttctctctcactttttgaattatgagaagaattagaaatgtagttaatgataatgtccaaccagtgtaattatacttgttagaaacacagctggaagcctgttgtccagtcttatttctcctctgtgatcctcattttcagaggttgaagtcataagtttgccatgtctactttctgacaggggaattataataatgtggagtcaccttttgtttgtgactttgacaatgcttcattgacttactcaccaattttctaatttttatgaagactttttgccgaaatgtagactcagtcttctctcttgtctactctttctataacaattaacaatgaacttatttacctttttaacatctttttaaaaattttctatacaccttgaaaatgtgaatacaaagtaatgctgcatcatgtatattgccttattcacacatagcctcttatggtatatcatataaaaatggaacaatacagcaacaggttgaatgaacagtaatcaggtaacaggaaaatgagatgtctttaatatttcacttaaaaactcaatttcctaaagcatacatataaatatttggaagtatagttagaagaaaaatatctttaaaatattttaattgattagtcttatttataagataatttttaggaggctggttgcggtggctcacacctgtaatcccagcactttgggaggccgaggtgggcagatcatgaggtcaggaaatcgagaccatcctggctaacacggtgaaactccgtctctactaaaaatacaaaaattagccgtgcatggcagcgcatgcctgtaatcccagctactcgggaggctgaggcaggagaatcacttgaacctgggaggcggaggttgcagtgagccgagatcgcgccactgcactccagcctggtgacagagctagactccgtctcaataataatcataatcataataataatttttaggaagcatcagaaatatataagaaaaagattattttcttaattgctttactaaaaacacctctatgatttttcagtaaaacttgattcttatgtcatgtgtgagtgtgatctgcctctcttgggatactactgtactcatgaggagtgatttttttctccaacgacctctttgtcacgtcaacaggtcacaggaatagtgtaccctaaaaagccacctgccacatgctgctgaaaatgtaaaagtacacacatacacacacacacacacacacacacacacacacacacacaccaaaatcaggtatcacaagctgaaaataaaattgagtccaatttttttttaattgagcagttaatgtccttaaaacaaaatcctatactgcaacaaatacttagccagatcattctgatacctccaaactgtggtgtattccaagatacctctatgatctttgatttgatccacagcttttcagttatcatgcaaataccttcaagttttatctcatttctcagtgcaaactcattaaaaattttcagctgaattcaattttataaacatgttgtgaatgtcctctttatataagcaaggttgtaaggaactggccacataaacagaaaattgaataacatatggtttctggccttagtgatctcatgtgtgagttaggcatatgggcaaaatcagaacactatagagtataagtctaaaatggtagtattttataatagaggatgaagagggtgctgtgggatcataggtgacagatataactcccgttgtgggacttgagaaaggcttcacagtctggaaacatttagttgctattgaacacaaaataagactcactgttgagagaagggagagggagggcatttcaatcaaattaagattctgtggcatattcggaaactgatgtttttaaaaagagtaatgtttattacattcctctacataaattatatttctatgtaatatgaatgacaaatatttaacacaaaatgccttataacatttgaatgaaatccatcatatgacctgttatctatttccatttcctttttgctcatatcattatgaacaatgacctgataaattttttataagactttgctgaattagtaaaggattattaagtttagaatgaacaaagctgaccaatcattcaggcaaatttgaccgttttgttgtcgcttttcttatttctgaaaccatacaattccctgaaatgaataagtacatatttgataacttcctaaattaaggctcaaaacactggtaatctactgggctttcatttgttccttctatttgtctaatcctatctatatttctttatatgagctatgaaaatattagatttattaagttgtcctttatcttaatagagaagaatgtttttctatgacattaagaggaatttgatttttttctttaatgatctacttttaattttggtagagtagcattgataagatcaatattacacattgttaagtatgcattacatgttgataagataaatattacacttaaaatatgtttatcaaatgtatgaatgataaaaacgaattctgaaatgtatgggaaagatcttgaataaaggtctatgtacatttcaaggatgtctacatatgcaaattatcataatataataactattgaatatgattatcttcacatactttctttatttttcatctcttagatgaaattgggtattgttttcttatagctggaacaaagcattacagagaattcttagtgtgatttcattgaaactcactgttatatgagttcaacaaagtttaaattagtccatgacttaatcatcctttataaatcctatcactagtattcggtaaggacaaagtcaattaaaaaattagcaacagaagcattaaaagaaggattaataaatacaaaataagggatgtgatatctttacgtattgctgagatgttagtgctaaggaaaaacttccctgttcataatgtgaggtgggaaaaagaagaactattattgtatatttctcctctctaaaactgcctatctgactgtgtttttctgtgtcagccgtattaacagatgtttaattttactcactttagtatataaggcatcataatgtatgaactatttcaaaggccctatgatggctaattaaataaaaatatattaaatattagctggacaaaataaaatatgtattaattttggaaaaagtagatcaaggttttgcagatcttttcatatcaatatattcatttgctgaataagcttttattgtttaccaatattactagttttatagagatgtagatatcaccacagtatgactaattttatagggacacagatagatagatgttattttattccaatcttatttttacatataacaggtataaatatgcgcttgaaaggagtatatcacttaggagtcagtcagaaaagtaaagatcttctagtctaatacagtggttctcagccaggggtgattctgctgcacgctgagggataaattggcaatttctggagacatttttggttgtgacaattgcaggagtgttactggtattcatttggtagagacagagatattggtagacactgtacaggacacaggaaagtctcttacaacaaagaattattctgtccaaaatgtcagttgtggtgaggttgggaaacactggtctggaagaaggaatttactatgaggaactagttacgaaagtatagagacatttaacaagctgaacaaaggatagtgagatggctcagagattagcaactgtggcatgaagccactactacgtttaggtaaaaataagctaccatttattcttatagtaataataataataattattattattattatttgagatggagtttcgctctgttgcccgggttggagtacaatggtacaatctcgactcacttcaacctctgcctcccagattcaagcgattctcctgcctcagcctcctgaatagctgggattacaggtgtgcaccacccctcccagttaattttttgtatttttggtagaaacggggtttcaccatgttggtcaggctggtctcgaactcctgacctcagatgatccatccacctcagcctcccaaagtgctgggattacaggcatgagccaccacacctggcccactctttcttttttaattattgagaaatataaaaatatgtcaaaagtaacaggtgtggtggagttacagcatgcacataatgggatacagcccattatctaatctcagatggaaactagaaaaaaaagagaagatctttgctaaagcacagattatgtggaaaatcatttagaaaaatagcttatcacaacattaaaattaaatcctttagctgatcatttttccttgctattttttcttttaaaattgagaagacagtgagttttttttctttattgtcattatcttgatgtcaaaaaataatatgcacattataagtgggaaaaaagataagtcgaaatgaaatgaaacaatgcgaggaaaaaaatgtcacaacactcttcaattagaaaaaatgacccccatctttcctccaaatagaaatgacgtaactgaagtagtggaactttctcttccatggcaactctagagaaggggtagatggcatgggattgtggacagatggacacagaaagaggcctcatttattgttattgttaaaacttttacttctagtaatagtgacacctccttcagcatttctttatcaattgtcaatattttttggatcaccagcatcaccttctatatgtatgtctagaaacctcctgttatgaatttacacttctcagagtcaagacagaaatgctgtgaattgggcgataaataaaataccccccttttattgccttgctttgtctcttaaagaaagatgcctgttgggggactatgagaatgctttgtgcttctggacctcaagggacaaatctataataaaaattatgcatagtgatgagaaatatatataatgcaagtttgtagagatcagttaacttatcttgtctaggcaattatttctaaacaatgatttcaaatcattaactataatatagcccattcataccctccatttttgtcaaatccctgtcaccttcaaggacttggccatcccataggctgctctgcttttaatagaggaagatgctgtaactcttggtaccattgccagttatgaatttatccattaatgaacattgcatttaaggcataggtttatctccttctccaggtatgaacctgcaggattcctacctgaagcttaagggagaataaatccacctgggacaatcaaggacagatcaaccaatcagctcaaagcaggtgtgaattacacagtttatttgagtgacaaggtagctaaagcagggataataaaagaagggagtgggttgatgtggacagacgaactatggctttaggaaatttggtagggactgaaacatattttgtgtaatttatgtgggtctaatagcttttgaaacttgtttacaagacctgtgtaagtggtactggcatattcatgcatgagaaaacatcaagggaaaacttaatagttcaaggaggtgacaaagaagagaggaaccaattattttcactagccgtcaaaagcaagaaaataatcagcttgagcccttcggggaaaagataggttaaatattaagtaacagtttgttattattccaagtgttttcttaaagttgctcccatactttcctgttttctctgagggaatttagtttttttgttggtttttttttttttttttttataactgtcattggtcagagcttgatttgatgccagtcaaatttttttaaagagattatgaaaactgcttaaactcttccaaagggaagatgggtcattcttaacatgtgtttcaagaggaagagcataagagcattatatggtaaggctgaaagcagatatcagcgtttaggggccatgaagaggtagagctcacattggtaggatcattgactagaattccagagatcaaaattgtatgttagtctagcattggggaggacttgtagctagtatcttcattctagcttgggagcctaggaatcaggttaggcatcttgcacaggaatgggccgatgggctaaaatctccttgagagagatgattaatccaggacaaaccaagcagtcatgccaatgaattactttaacagggtacttcatatcctcatcctttgggcagcacggtcttcagagatggggcaggccccaggctgcagttgagattctataaactaaggtcaaaaagatgcagcagtgaagaagtcatgcttatcttgtataaatcatgttttcttttctttttaatgaaaatgtacatttaacacattttaaaactaaatattgaccctaaaattccaaccaaaaaatgctacataagtggtatttatttttgaatttccctcatgctcctcccactgtggggacaaggagtggtggtggaagagagatcttttagcaaacctgtgagtagagaattagaaggtaatgggaggaaggtaaaaggaaaacatcatagatggataggctcacaaacattaaaggccttcgtgcctgtccttcatgcctattcatccctctccagtatgtgaatcaatgtacttgttaaatattcattcacctcacatatttagcattaaccgtgtatcagggacgttgttagaccgttggtttacgatgatgtgtaaaatatcatttgtaactcagactaactggaagtgctcaatataataagatgtaatgttatggaacactaagtctgtgctgaagacttatctcctttaatcctaaaacaatcctggtgggtagtctcaatgatcatctccaagtcacagttgaggaaattaaggcttcaagaagttaagaaactggaccaacatcacaaaggtagcatcagagtgacagtttgatttcaaagtgtacttgacttcaaggcccacatttccttgcacgtttaatattgcctttctcaggtaaatataccattaaatgtgatacaactctaagcatttgaattacttacaacgtgcagagttaaaaccagcattatttacactatacttcagctcgtttataagtgaactattattttgtggactaacctatgaaatgtaaccacattgaattcctctgttaggtacaggtttggtgattccagggaatagagtatgactgaatgcacaggtaggggtgaagtgaacccggtcagaaaatttagagagcatcgagcagatcattaagcagctgtctttcaaatgtgcagaacacaactcatttgtaatctagggactatctgtattgattcttcccagggaagttacttatttttatacatatgtggtgtgttctgtccataataccattctacatggtaatgctcaactttattatttaaaaaaactgctaataatgaggtttttctttgtatcacagaagcagcaggagcaagttttctttttccttcccagtttttttaagtactgccaaggaatgtgattttgtcagacttgtatttcctattaagccaatctgcatgactgttccttctactagctttacctgttcactcatttattaattcatcaaatatttgtagagtgactattgtgtgccacatactaatataggcacaaggataaccaaaaacagacaaacgctgtcctttcaaggagctcatatagtaatgggaagttaggaaaggagaaaataaatatgtggtatttcaaatggaagtattaaagtgttaagaagaaaagagaaactaacaagatagggaaaaagtgacaggaacatgatgttttattttttatttatatatattttttgagacagggtctcattctgttgcctaagctggtgtgcagtgacgtgatcatggctcactgcagccttgacctccctgggctcagatgatcctcccacatcagcctcccaagtagccaggtctacaggcatgtaccacgatacccagctaacacgttttcttttcttatagagacagagtctcactgtgttgcccaggctgttcttgaactccggggctcaagcagtccacccacatctacctcctaaggtgctggaattacaggcatgaaccaccatgcccagccgaaattgatgttttatatatggcagtctgggcagacctctttgatgtgatatttgaacagaaatctcaagagagggagtgtattagcccgttttcataccgctagaaagaactgcccgagattgggtaatttataaaggaaagaggtttaattgactcacagttcaatatggctggggaggcctcaggaaacttaaaatcatggcagaaaatgaaggggaagcgaggcaccttcttcacaaggtggcaggaaggagaagtactgaggaaagggggaagagacccttataaaaccatcagattttgggagaattcactcactatcatgagaacagcatgggggaagccaaccccatgattcaattacctccacatagcctctcctttgacacctggggattatggggattataaggattacaattcaagatgagatttgggtggggacacaaagcccaaacatatcattttgctcctggcccctcccaaatctcatgtccctttcacatttcaaaaccaatcatgccttgacaacagtactccaaagtattaattcatttcagcattaacccaaaagtccaagtccaaagtctcatctgagacaaggcaagtctgttctgcctgtgagcctgtaaaatcaaaagcaagttagttacttcctagataaaatggaagcacaggcactgggtaaatatacccattacaaatgggagaaattagccaaaatgaaggggctacaggccccaagccagtccaaaatctatcagggcagtcaaatcttacagctctgaagttgtctcctttgactccatttctcacatccaggtaacactgatgcaagaggtgggttcccatggtcttggtaagctccacccctgtgggtttgcagggtagagcccctctcctggctgcttttacaggctggcattgagtgtctgcagcttttccaggcacgtggtgcaagctgttgatcgctctaccattgtggggtctggtggacagtggccctcttctcatagctccgctaggcagtgccccagtggggactctgtgttggggctccaaccccacatttcccttccacactgtcctagccgaggttctccatgaggtcttcattcctgcagcagacttctgcctggacatccaggagtttccatacatcctctgaaatctaggcagaggttcccaaacttcaattcttgaattctgtgtatccacagactcaacaccacgtggcagttgccaaagcttgggacttgctccctctgaagcaatggtccgaactgtaccttggccccttttatccatggctggagtggctgggacacaaggcaccaagtcctgatgccgcacacagtggtggggttgggggggggacctggtccacgaaaccatttttgcctcctagacctctgggtctgtgatgggaggagccgcaatgaaggtctctgacttgccctggagacattttccccattgtcttgcctattaacattgggctccttgttaaatatgcaaatttctacagccagcctctccagaaaatgggtttttcttttctactgcattgtcaggttgcaaatttttcaaacttttatgctctgtgacctcttgaatgctttgctgcttagaaatttcttctgtcagataccttaaatcatctctcaagttcaaagttccacagatctctaggtcagggtcaaaatgatgccagtctctttgttagtcatagcaagaatgacctttactccagttaccaataagttcttcatctccatctgagaccacctctgcctggacttcagtgttcgtatcactatcagcattttggtcaaaaccattcaacaagtctctaggaagttccaaacttttccacattttcctgtcttcttctgagcctcctaactgttccaacccctgcctattacccagttctaaagttgcttccacattttcaagtatctttatagcagtacctcactacctcagtaccactggtcttaactcctgcgctcaagcgatctgcttgcctccacccctaaagtgctgaaattacagacatggtccattgtgccgagccaaaattgatattttatgtatgacactctgggcagacctctatgaggtgacatttgaacagaaatctcaaggaaggggagaaattatccatttacatatttggggaaagagcattccaggtagaagaaacagaaaatccgtagtcttgaggaatgccgtgtatatgcagtatttttcaaacttgttattttgaaatacatatacacttacaggaagttgcaaaagtattaagaaagatcatgagtacccttcactcatcttcagctaatggttacatcttacataattatatgtaatatcaaagccaggaaaccaggaaattgatgttgatacaatctatgctttattcagatctcacatcttacatagctatgcacaatataaaaaccaggaaattgatattaacacaatctatgccttattcagatctcaccagcttttacatgcacttatctgtgtctgtcattctatgcaattttataccatgtttagagtcatataacaactacccctattttgatacatggtactgaatagttccagcgtcacaaaggaactatctcaagccaccctttaattgtcacacccatccaatctcccattctacttcctgaatcactagcaacccctaatctgttctccatctctatgattttgtcttttcaagggagttttctaagtaaactcatttggggaaagaaaggagatgaattgttctagccacggagtggagaacagagagtaagagtacctattgaagcagagggagtcattgcaataattcaaatgagaaataatggtgattctaaaccaggaagctttcagtgaaaacaatgagaggtacatggattctgggtatttttggaaggtagcactaccaggtttgctgatgaatggggtatggggtgggaaagaaagagaagagcccaggatgagtccaaggtggataaggtgaatagaattgagaaaatggtagaaggatcaagttagatggtagaggggtaaaggtggaagcaataattttgttttggaattgttaggtttgaaatcttgttagacatcccagtaaagtcacaaagagtgcagttggatgaaagtatgggattcagggaagaagtatgtgctagagatgcagatttgagagtcatctgtgtggaggtattattcaaattcaagtccccttggaatgaatggctattcaggcagggtcttcataaaaatgcttgttgcatgcctgtaatcccagcactttgggagtctgaggtgggtggaacacttgaggtcaggagtttgagaccagcctgatcaacttggtgaacccccatctctactaaaaatacaaaaaaaaaaaaagttagctgggcgttgtggcacatgcctgtaatcccaggtacttgggaggctgaggcaggagaattgagccaagattgtgccattgcattccagcctgggcaacaagagcaaaactccgcctcaaaaaaaaaaaaaaaaaaaaaaaaaagcttgttgcttcaaattcatgtcagtctgtaaaattatctgggaaggcagtacaaaaactgtcactttgactacgatgtttctggtgacccatcttcattgatcagtatggaaaaggcatgtctctgaaaatctctgagagtctttgatacagcaagaacataaggataaatcattcttctatgttcatggttgtagaggatcttgaatgtttaatggcagaatagccagatcacactctggcacttctgtatgagaggctgagggatgttactgattcaccccgagaaatatttactactaaggggacagaggcaaaggggatacaagacttcaccctgagctgtagcgctccctccttccctatcctgctttcattcttcacattgttttccttctttcttttttattattatactttaagttctgggatacacgtgcagaatgtacaggtttgttacataggtatacatttgccacggtggtttgctgcacccatcaacccgtcatctaggttttaagccccacatgcattaggtatttgtcctaatgctctccctcaccttttccctgtgtccacattgttttctttctttttgaagcctctcattcactaggtttcaatcctgccttgctagtgttctaactctaaggcctaggcaagttatttcaccgaacttagcctcagtgtcctcatctgcaaaatggatagttttatgatatcttcagcccttaaagtcaatggttctgacagctagggtgtactatcttcttggatatcagtcatctcaagcaagccctccttttttggaccttcttttcacacacttcacataccttagagaacataatacacatcctctttactcagggcttattctttataacaggcttcctaattcaattaactcaacttttcaaaaatattagtgactactgtgatgtaaataaatttgcattttataggggtcttagtaacccagaagggagtggggaaaattaatatatattgagagtttattaagtgctaggtactgtaaatattttcttgtatttaatcctccgagtaattctacaacaaagatattatcattgctattatgtaaataaaagaacaaagtagaaagaaacccacggtcttgtataagctcccctagttggtgggtattgaagggagtatttcaatctttggtagcttctgagtttttgttctctcagggaatctgccagatgtccagggcacctgccaaaccctatgaggctataagaaaaccattaagggtcttagattacccagctttttgggagttagaattctgaatgaaatttagtgttcctgcagctacaaaggaattgagttagggaagtgatgactttatctttagctacattggttattttccttataataatcctggcttggtagattagaggcagcccgagtaacccagaatcgctaaaatagaagtgcgagctcattgcccgctgtccttcactatgtttgcatataggaagcaagaataaaacaagcataaaataggctaactagcttgtcagagctcttcacaccaagtctttgtgagttccaataagacactgactattattaaaaagacagagactccacataagtaggaatttattgttttccttttcagtcaccaaaggacaatcctctgcataggttagcaaaaaatggtactgatcctataatctctaatattaaagtttagatttggcaagctgtacatcttatgttgttcattaacaaaaaacaatattgattggtatcttgtactataacttgtactgtgggtcaaattccaatacagcaaataccattgcaataacaattctacaaaactacatcaaaaaaacctttcatgtttgagccaacagcctgatagtgctaaggactttgagtacagtatgctagaagattcttaacagttatttgtcctggacaacaaaggttgactccattaaaaacatagccatcagtgtgggattatttccaaatcaagcttttggaaaagtcaaatgaaagtttgcaagcaggtggggcatggtggttcatgcctgtaatctcagcactttgggatgctgaggcaggcggatcacctgaggtcaggagttcgagaccagcctggccaacgtggtaaaacccccatctctactaaaaatacaaaaattagctggcttttgtggtgcatgcttgtaatcccagctactcaggagcctgaggcacgagaatcacttgaactcgggaggcagaggttgcagtgagccgggatcatgccactgcactccagcccacatgacagagtgagaccctgtcttcaaaaaagcaaaaaacaaacacgcaaacaaaaaaaaaaaaaaccaaagttggaatgcaataaatgttcattgaatgaatactgaatagggagtttcagctaatccactcaaaatagtgctgaatttccagctctaaggtcaatgcttggcatatatatcctgaaggaatgaatggacacagagtaattttttttctaaaatgcaaattcaattatgtcacttcccttcttaaaatccttcagtagcttcccgtagcctccagcatattattttgaatagtgcttctcaaactttgatgtgcatcagaatcacctggggattttcttaattaactgatgctgattcagtaggtctggggtattgtctgagattctgcatttctagcaagtgctcagggttatagcaatgattttggcctgcagaccatactttgggtagcaaagacataagccacttaacttgacataaaagactgtttagacccttagtttctctctcgctctttccccattttgagcttttgctccggttcatgtttttccctgaaaataccgtgatcttacattgtctgtctggatgctgaattttccctaattctgggcctccatgtagttttaggtttgacatcacaaccaccaaaagatttccccttctcccttaatcttggttaatgtcactctcatgtattatactgttaatgaagcattgaggacataaaacttatcaaatattttatcacaatcaatgatggcaccagtgataacatccaaatgcctgggtgagtaaataagaggagaataggggacttgttgttaaactaagtttgcagagaaaaaatgtactgattataattaaattggatgtttatttgttatgacaaaaaaggagctagagtcttttaatccaccccttggcaccactgcttatctccttgtaacatacgtttgattcccatgtctatttcttccatatgggaaatttcagctccctaaacatcaccaatacaacctgttgataagacaaagttaaatttattgcttactatggtaagaaagaccacagcctggacaaagctttggtagtatttcataaggagaaaggtgaggttggatttcattgggagtatgaagcttggtttaagattggtctttcactgtgggggcacaattaggattgggtaaggatcatggtattacaacttagtttggtggaaacagcacagtgaagatttctagccaagaggctcagagactattaaggtgtgaactctattgatgttttttgttgaagagttgatgggagtttggggaagttactttagtgaacagtcaaattatttgcctggccaagagttatctgtaataggaaagttatgctaatgaagacaatggaaaggtaaaccatgttaatgtcgacagccagctatgtgagcataaggggtaggtagctttggtcctccatgtccaaactgtttgtagtggtaagtgatcttcattctcacatagattgaaagcttcctgaggacagggcaatgtctttgtaaactttaaaatatctatgtcctgcacatcacctgccgtagacaagcatctagtaattgacggttgggtagatactgagggaaaacatgcaccaaataaaaatggcaataggacacaaattcactatcatttggaagaataacagtgttttccactgatatttgctacacacagtggggtccacagagcagcagtaccacttgggagcttattggaaatggagactctcaggcaccaccgcaggtccaatgaattaaactctgctttttttaaggtcatttgtattcaattattatttttttcttttttctttactttcgatgcatttttctttatttgtttttgagatggggtcttgctattttgccgagtctggtcacaaactcctgagctcaaatgatcctcccacctcagcctcctaagtagctgggatcacagatgtgagccaccacacctggcttgtatcacattaaattttgaggagcagtgctttaatatctattccattctcatcacttgatgaggtattattaattccacttatggatgtggaagttgaagccagaaagtttaaatgacttgtacaaggtcaaacagcttacaggtagttgagccaagaggctctcaagtcttctgcctccacaaacccctgttcagctgctgccctacaatggaataaaatatactaatcccagagggacaaatatgctaaaaatctcaatattatacactttggaaggtgcaggtgcattatctttcaattctaatttctctttcaagttttctgatgcataaaaatatgaacagcaggtctgagcaatgtttagatgccgtgctttgatccttttgccattcaagatgtttgatttgcattctgccaaggaatgtctggtaacctccatgatgcagaccacaccattagtcaagagagagctgacgtaccttcatctgagagctggctggctgtgagctgctcagagggaaaggatttctatttacaaattgtatcgattatttataaataaaagttccccttgctttcttcagttgtaaaatctgcagttagagagtcgggaagaagatcaaaactgcatacatttgcatctgccaagcctgataactagttccagaattacagaaatggtgctgaaatagcacctcaagtaccaggctctatcaaatttaatctatccataaggcaactgccaattatattttagagaaaaaatgtagactgaaaagatagacaatccaagtagcaactcctgtaaaattatatgcccataggagcaatcttgaagatataaatattggtatgtttctccttcatttatcatttatctgatcatttgacaagtatttattgaatgcctgttaagggtgtagatatatgtggtgaggctgcaggtgtaagtaggtctttctgaggatatgcatgaagttgatgttcataacttggagatgtgtgtatacagactgaggattccttcagtggatattaagaagtggagtaataggcagtaaagaatacactagtcagttgtggtacataaacacgtcagcaccacttaggtattaacttcctgttttgttttgtgtgtgcttaattacgctgtttattaaacaagcacatcataatctgcagatattgtcataaacagcacaataaagcctgccacatcagaatgtcatctatcaaattaggtgtgttcctcagctgtcccgataggcacacacctgtgcctgtaaataggcgcttggcggagattgcttccaggtgtggatctgttgggcgaccttgggatgtagggcactttggaaccttttcctctagcttcaggaattaacctctgggcttggttccatgccagcttgcattttgctttgggacagtaacatgtaaagaatatgcctgtgaatttagggttactgagaagtcctcatagaagaagtaaaatttccttgaggaatgggagtcttttattcaatccaggtttaatgcaaggcttggtgaacagctccagaaggttaataattgcgtgcgtgtgtgtgtgtgtgtgtgtgtgtgtgtgtgtgtgtatccttttgtcattcaaaagtatacgtatacacacacacctgtacagctgatgataaatatacattgtatcaatgagttcaaatgaagtgtgctattcattcactgaggaatgggctattataatgaactattatgatattagaaattgtcagggcaataagcaaataatacatacggttttcaacaaactttctaagtattgttatcagtgggtttgcttaaatctttttttacaaatttatttatttttttgagacgaagtctcgctctgtcgccaggctggagtgcagtggtgcaatctcggctcactgcaaccactgcctcccgggttcaaaagattctcctacctcagcctcccgagtagctgagattacaggtgtgcgtcaccatgcccatctaatttttgtatttttagtagagacgggttttcaccatgttggccaggacagtctcgatctcttgaccttgtgatccatctgcctcagcctcccaaagtgctgggtttacaggcgtgagccaccgtgcccaggcaatagccccattgctcagtgaatgaatagcacactttattttaactcattgatataatgtatatttatcatcagctatacaggtgtgtgtgtgtgtgtgtgtgtgtgtgtgtgtgtgtgtgtgtgttgaatgacaaaaggatacacacacacactcttattaaccctctggagctgttcagcaaaccttgcattttttactttcattacagtgtgtaaataatttagcaaattctaatttgaacctgatatcaattgagcatttaatatttagccaaatatttatcaagtgctgactgtgttctagatgctggggctgcaatttcgaaacagaccattgaggccctcatggagctcacaataaatgatcttccttaaagtatcaggtctctggtttgttaccgtattttttaaattgttaaggaaagaaaaaggccctatctttttgtagacaaacatgccctaagtgcttccagaaataatctccatcaggtaatgcagactgtgtgtggagtgaaattgagtccaatccatgatccagcagagtttcagcccaggatttctttagagcctttgctacacacaaagttggctgatgtgccattcagcatcccagcagctctttctcttcacactagcaatggcaaagctttgtgcggaggcattgctggctgctctgaactaaaagcatccgtggggaccgaaagaggtttttgcacaccttattaaggtaggcaagtgtgtctgagtgtgtgtgtgcctaaaagctggaagacatctgttgagaggaaagtgctcttctgtgggtctggcagcttttctgtaagtcttctattctgatgcaggagcgtgtgagcagtgggtgggaggagatgctttggtacttggaatgctgaggtccggattaagtggtattgtaatagctagttagaggcagaataaaaagctgggaatcaaagcatttaaaaatgcatccttccattatttgctctcaagttaaaccatattcattctaggggaaattaaaaaaaaaaaaaaaacacagcaagggcaagtagcccaaatctgtaaggtctttgagcttctctgttcgtccagcttttgaagtcttcctacagccaatttgtttggctcctctggagggggcaattcatatccacttccctctcctggagcatttctttcttctatactccatcagggaacaatagagtttaacagtaacaggcaattttttttttttttcaaagcttgtgccctcttctgcgtttaaaggtgttttttaagagactcctgctaggggaatcttggcgcctgtgtgttaagacggcaattaacttttagtatcagtgcttacattaaattttctctctttctgctttactaaagcagtcattaaaattcagtgtgagtaccatgaaactttatcataaaaccctgctttgcttagagaaccttgattgttttctgaaagcagccttctcagtttatatatacatagctgccttccttggaatatcaaattgctttgtgtcacattaagaaacactaggttgaacctctatactgtgttttatctgagaaaaatactactgcaaaaagtttgatttgttcaagttttaggatgaaaatttctttgtaacaagttatttgagttgcatactatgtcatcgtatatctctttagttcaagtaattttgcaattaacatacggttatgtaaagaagataatgatttattttttatttatatttttaaaagttattaagtgaggttttcctttcagtaagagtttagaaaaaatagccagaacaagtaactggacttggaagataaagatacctttgcacttctaaattttacctttgtacacttcggttgtgatttaatcattgaaatgcctctgctttgaagtaaatgcatcacttatggtgtatgctgtgttttaataaagggaaaacagttatgggttctctgttgcacatttgaatgttgttattttttgctgtatttaataacctcttttttctcttgtgaggtttactttggaaatgaggcatgttcaaaaataggctgacattcagcttctatgttttaaatttaaatgctgtctgtgttttatcacatctggaatgtgtggggagaaaagataccaagttttattatttagatttaattgtagaattgcagattgatatttttcaatgcattttcattatagtttctgccatggaggcagcgtgagggctttcaggaagatggagtggtgtaattaccaggtgcgcacgttcattaatccttcctggctagagaaagcttcaagttcttctccagtggcccattcgtaaagctataaatatctaaattgtgtcagccaagaagtcacacagaatggtggctctttttgagttcaatttcatgcactgttgctttggtcttgtgaggaaagctctgaattccttaggatagtcttggttgtgaagttccaaaaacaaaatatcaaatcattaaggatttaatttaaaatacatactcttctttcacaaactagatgattgcagtaatgtggattataaatttttttttttgctttatttctttagagctcctctttttattttgtatgatcaagattatagctgagattttggtgatttttttaaaaagatttatggcttatggtccatcagtctctccactacttcaaacctgtgtacccctgtatattatctgcagtactggaatgtttgcattgtatgtggaagctatatacgatttggtaaaaaataacacttaaaggtcttcgctaagagtgcttatttaatcattaaatatcccttaataaaaataattccagagatattgtctgtgtacaaacttaaaaaaagagaaatataaaatactgtgatgtgaataaaatgtatagcaatacactccaataataccattcttatgttttcccttgttctcaactgaaataactaagctaatagagacgtcagtaaggaatgtgttgtttcttcataatacaactacaaactcatctgataagaacaacctgagagtgaacgttaactttcctcattagaaagattcaatttaacacatatatacaaatacatttttaagataatgatatttgcagagtttttgtattctatggagtaaaggagaattatcacatattcaaagtaaaggtataaaatacatcttaatgttttacttaaattttaaagggtccaaaatatactaaaattgtttttctaattctttcctatgtttaaacgtgccagagtcattggaaataggacattctttttcttaagaagattttgcccaaaatatttaaaactattttcttttcccttgattttacaatttcaatattcatggatttttctactttaaaaataacagtagtttttatgatcttaaaacaaatgtttaagggcactttcgctctctggagactataccatccacatatttattatcagcaaaagaaagggcagggcatacttttatttgaagttgagtataaaaatgtgtctgtgtgtgagtgttattaaaaagataagtgaagagacaaatatagaatccaggaacattttcagcctggcttttactctctctaaaaatctaatgaaacccttgagcatctcttatctcaaggtacattaggaactgtccaacactatgatccgatgggagatcagtatattcatataaagaagaaaatttgttgttagtgaaagtcaagtcttttaaaaaaataatagttacagcatttgcaatatacaagcataatagatttactcaacgcccaccccccatctttaaaaaatcaatttccgacagttgtctactttaaaattgaacatatttgctacctggagggaacattgtaatgtagcccatatgtggtatgcatcctgaagaaaacctgaaattatagaggaagttatcctgccttctttcttctgttgaatgagttaaaatatattaacaatttgcctttcactttgtatttatcattttgtatctttgcatatttacatatacattcatgtgtacaagggcatatatactcacaggtcagggctatttaaacagctatttatttgaatatgccagggaaaatctccaagatataaagaagcagttattagatactatgtcagtatagaattaacagccatcttttttaagatggaagagaaaattaattaattacatacaatttctaacctcaagacattttctttctggagacaaggaatactgaggtgctcacgatagtgaagactcaacaagaccctaataaaatagatgaggataagtaaaactacaatagccaataaaaaacaaaaaacaataaaccatgtttcgctggcatgttggtgagtatctctgtaatatctgtcaataagggtctctgtagatttggagtaatgttcaggaactacctgtactagagaagacagtggagaggactccagtggctaaattctgctgcctttgcttccagaaatgtaaataataaggaggtattgtggcatttcctggaagcagtagtcttgtttcatggtctgactgtataagaatgcctagagaaacataacctcagctgactaaactcccttgatgattgtcactttgtcactgaactctgaccataccttttgcctccagaggcaaaagacgggtgaggaagtgatctcctcatctggtttttaaacaagtatataactagagaactggattatctcctaaacccactcttgtccctggaaaaaggggagtcatcctatccgtttcttagccaatttatgtatactcttagtttgagagcatgagaaggaaaactattttcttttcttaccttggctgggtttttaagaatttatttttagtttaatcaaaataatattttaaaaggtagtaagcctctcataagcagtttgatctgttctaaaataacttcaatttttctttttttaaactttcttttatcttacacacaaagtataatagtaatatgtactcactagaacaaatgaaacaggatggagtcacatagagaaatatatcatattctccctatcccctcccttaatattaacatttaggtgtcatgtgcttctccattaattttcattgcaaaggcctaaattttcttccaagagtgaggagtagcagcacggtagtttggacctgatatagctctctttccctagccttttgcttaagtgctttcctaggggctgactttacttacctaaagatgtttcaagcaagggctcacatttttggtagcagaagacacttactgattgctctcactaataattttgaaaggaatgtcaaaatctgggaggatcatgaaagaaatatcagaaatttcctttcagctgccattctccttaatactgttatcaataaattcagcatctcatatgtgatagcaaaaaaggtgctgccttttgttcttgcatcctgaggttcttacctaataccatggtagcaataaagatggtgagaaaattgcttcttctatggtgttcaggtcctgaacgagcaccctcacctccacagacggtggcaggtattcaagcattttacagactttggagttaaatatagcagtgttattctaatttaggtatgccaccaccagcggcaccggcaactgcaataggaaaaatgattggcaatgccagctatctgatgttttcatgtgccaggtgctgtcagttcttcacagtattacattccatcctcacaacaagagagtgccagtgagtgttgctgtgtgccagtgcccaggctaagggctttgaacacattaccctgttttatcctcataactttccacgttatttttattcctgaatgaagaaacaagttctctgtagagatgctgtcattgatccactcatatcctttcacatccgtttaacattttccctgctgtgcttttactcccaacaactagctccctaatcgctctgttggagggtggccttgaggctgccagagcctatttggtctgtgtaaagagagagatggatctatcctggaatttatgtccctgtgtgtgggaagcccttaatcaatgactgctggttgcagacacataaatacgtgagctttcttgttcccaactgagaaattcagaagtgtgaatggcactgccaccctgggcttttatgccatatatgtgtttggtctgtttcccttcccaatctcacttcattttcccttaccagtgtttcttgaaaacacatcccattagatcatttttgcatgaagcttcatctcagaacctccatttagggaacccaaactaagatattctctaaaatagaaactttattgataaagtttccaaactgtcttagtagatggccaatataagaccaagccaaatctttctgggtccaaattccctgtctttaattaatagactccattacaacacattcttcaatctttagtcagcaaacacttaccacgtgcctattttatggcatattatatttataccatagttaggatattatggttcatgaatattttatatctgtacacctgaaattctattgacctctctgggccacagttttgcatctgtaaaatcagcacaataatgctacttatctcatagagtagacttaaaaacgaatgaaatgatatatgccaagtgttgagaatcacaattggcaattactcatgctcattaaatattagctgtttttatgagtattgtttcattttcggtgcataatatcctatgcaaagaacaaaaggtattggtataggcattgaaacttgaagcatagaagaaaaagttaattaaccggtgccccactagatgcctctaactgctggctccgtgtatccctttagccttggctcgtcacgagaaaaccttggagacatttctgctggactcagcagatcaatttaagaaagatgaatgacatttttcttgaaatgtattcagtcatagctgcctttttctactttcatattttggagttcttagaaaaaattaaggactcctttttttaaagaaaatggtataaaagaaaatgcatatcactttgtcactttattattgtaacctcatcaaagtattcagtgtaaagacagtagccaagtgaactcttcttgtaatgctcggaaaccattttagcaatggtaaaattgctgcaatttatattcgtcaaattgcatgatttgacttattttagaaaagttattaacttctgaagagaatgcttcagaagcatttaaatgagtacaagttatcaccagtgatatacataaatttcatttcaaaatatacttctagaaactgtacttagttagctatagtatttgtacaaggattaattcctatttcattttgtaggaatttatttatgaatgtctatggcctgccagtgtaaagcagacttagagcatcatcttttacaataatctttttttttttaatcaaaggggagatattctggtaaaacaaaacaaaacaaaaacaatagtttattctgcatttttattaagtccctctgtaagtcatccctgaaatgggatatgtagagtcttatatttatttatttctcagaagcttattggaggtgatatgaaggattttaagaccctactaactaacaaaacaacaatttaaaattaattttcaaaataccttaacaaatcttattctccttattttcaaattctttaacaatgtttttcttattactaacataatatcttctgatgtagtcataataatatctaaaatgacaggtctaagtaacttacatggattaattgagtcttctaaatagtaaggtagatggcactattacttctatatgagaaatgaggaagtagaggtataaataagaaattttttggccgggtgcggtggctcacgcctgtaatcccagcactttgggaggccgaggcgggctgatcacgaggtcaggagatcgagaccatcctggcgaacacggtgaaaccccgtctctactaaaaatataaaaaattagcctggcgtggtagtgggtgcctgtagtcccagctactcgggaggctgaggcaggagaatggcgtgaacccgggaggtggaggttgcagtgagccgagatcgcgccactgcactccagcctgggtgacagagcgagactccatctcaaaaaaaaaaaaaaaaaagaagaaatttttttgagtgtatacagttagaaaatggcaaaatgggaattcagacccaaacagtaagactcaaggatacctttcttatcagtatgctaatatgaaaacctaagcatactagaaaatctaagtgccagttggaaaccagaattaacattttggtgtgtaactttctggctgctttttctatgctaacaaacatatatgacatacaaaaatacacacatacacaaattcctgttcactacttcttttatgttaacatcacaatgtaccgtacacagctgtattattttatatttgatttcatattttttctaaagtcagtgtatttgtcaaatatcaacttatctatttaataggaatatgggatgatctttgcttatacatacatacatatgtatataaaaacaaaatcaagtattttaagcgttcaccagaagtcatatgtcaatcagtaaagtatataattttttgctgccaatgacatatatcataaaaacgctacctatcatagaatgaaaatgaaacacagcaatattgggacacctattctcaagcaacagctttgtgatttattagctatctcacatgaaataactcattaacttggtattccaagcagcaaaagaaggatcacttaggtcacttgcaaaataatacaaagctaggtttaggggtgggttgcgcttggtgggatgtagatgaaaccatatgggcccttgagtttataattgctgggatctgcatggtgggtatatggatgtttattacagtatgctagtgagttaagaaagaagaggaattattattgacttacatcatagagtttatgcaaaaattaaacgataatttatttttaaactctagaggtataggtaccatcatgaagggacccacagaactgatgtagccagtaattattggagctggaacagatactctgctgtcagttgttctggttttgtggtcattgttcttgcctttgcaagttaccaactctaagaccttgggcaatactttaagtcttggttgtctcatctgtaaaatggggagagcagtaagtgtcttaaaggtttattctcatgttatatgacttacggtatgtaaaacatctgcgtttagacacatagagggtgcttaatggatgattgctctcattattaggctacatctaatctatgaatttaaaaactgtatagaaatatgtgacagattctttaagagccaaataccaactacagtgaaaaatacttaacacttgctgagctcttagtatgtgtcaggcttaactaccttaatgctcatagcaatcctataagataggtactcttgttatcctattttatatcttctaaaattgaagcaagggaagttaaataataggacaaagatcatacgctatctatccatatatacccatctggctgtctacctgtctccttccatccatccatccacttattcatctacccatccatccactcagttacttctctctctcccaccatccctttccctttccctctccctctccctgtctctgtcactctcctttacttatctatctatcgatggatcggtttatctatcatctatctatctctatcatctatgtatagttgttaataacactaacattttataaattacaagactgaaaaatgttttcattaacttatggtaacaaaagaccacattgtgaataaaaaaagcagtaaacacaggtctctgcacatatgaaagagatgtcctaaacaggaagagatgtcctaaacagtagggatacatagtatcatacaatcaaaacatggcagccctataaaacttacaaagcaatttcatgtaagttatttcatttgactcttaccacaatctatgaggttactatttttatttttctcattttacaggttaaatttaatatggcttccaataaaaaattagtatggttaataaatatcttgacgtcttgctcctataatcctaccgatagtttacagtaattagtaaaataaaataataggaaaaatacctttgatactagtattaaattataatcatatcattaggtaatttcaatttgtgattttcaagaatctgtaatatggtagcttcttcctactgacatgtttgaattcattttaaggcttataattcacaagtaatctatatattatctaaaatgtaaatgcacattcacatggagataataaattagcgtgaaatggctgtattttgctctctataatttttaacatacaggaaatcactgttgtctcaaaaatcaaggaaatatagtatttgaggtgaacttattctttctactattaacacattttaatatagttctctcacagtgcaacagagcaagaagctttcagacacatttgctgctgcaaggagcatgctgtgctgaacttaaaacaccttccctttcaaactccttgggactgtttttttccaagagacttcaaatgcactaaatttagcatccgttggaggcacacccaggcatattatagtgaaagccccaataactgaatgtgttaccactattcacaatgtttatgtgtgtatatgccttatctatgatgtattgcaaattacaaaaattgtgttattattcacagtaacaaaaacacttccagcaaatttctaacagtgatctcttttgaaataacttacatacatgtgtcatgggtcttaaactttgtcacttttatgtttccatcatgttgttttagccagtgagggttttgtttggttttcatttatgattatatactttcaaaaaatagatttcaaagtgtgaatttgattgattgattgactgattcattgagacggtgtttcactcttgttgcccaggctggggtgcaatggtgcgatctcggctcaccacaacctctaccacccaggttcaagcgattctcctgcctcagcctccctagtagctgggattacagatgtgcaccaccacgcctggctaattttttgtatttttagtagagacaggggttcaccatgttggccaggctggtctcgaactcctgacctcaggtgatccaccctcctcagcttcccaaagcactggaattccagacgtgagccaccgcgcccagcccgtgaattttatttttgaaagacaagaatgtccttgcctaattgcataatagtttaacatcatgaagactaaatatgctttttagccatgacaattttatttattattgttttcatttttaattttctcaaagatcctcatcagtgtactctttttggtcttccttataagcgtattttaacaggacataataataagataaatcccaactttttaaagttgtatccgtatgtattactttaaagtgctattaatataaacgaattagaggcaacttttattcaatcagattttaagtaattttaccaaaaatatggccttgataatgtctctgtaacaggttctctgtaatatacatgctgaggattggtttgtctttgcttttgatactattttaattagaaaagtaatggggaatccagacccttctcatttaataatccagagaaaaatcagtccatgttctaatagtttaaatttttctactaaaacccatgtgagaatccatatgagtggaatggagaggagttcagcttcaaagttggcagatttgagatgattctatggcaacagaaatgtgcttgagggaaatcagttgcggcatcttctataattgtgtcacctagattttgccttaggaatttctagatttccatagaacattgtgacctcaaatgctttatcttaataaagaaataaaagcagattagaagaattatttgcctacagtttgtgggagatgggcaagtcttaagagtttattaggtacccagaacgaaacatattttcttgggcctcataatcacattgaaatacaaggatttagttatacacagtgaccagttagtgaatgacagtcttcagtatctagtagacagtaaacatataaagatgtatttgtggccgggcacggtggctcacgcctgtaatcccagcactttgggaggccgaggcgggcggatcacgaggtcaggagaccgagaccatcctggctaacacggtgaaacctcgtctctactaaaaaatacaaaaaaaaaaaaattagccatgcgtggtggcgggcgcctgtggtcccagctactcgggaggttaaggcaggagaatggcgtgaacccgggaggcggagcttgcagtgagcagaggtcaggccactgcactccagcctgggcgacagagggagactccatctcaaaaagaaaaaaaaaaaaaatgtatttttacttttaactacagcgagagaccctggcagcctacagcatacaattagtgttcattatttagattgcatggatttaatgtgaggggtcaattacttgtctaaccagtgagcctagcctcttgctcaatactgcctgcttcatgagggtgaactgtgctggagaaatatattacaggattatctgcagattttttttaaatgagtggttaagtcaaaagttcttgtgaaaattcagagtaataaattattatgaagttgtgtaactaggtaaaggatagtttcttttacacgggtaaagattaacatgaggaggaaaactttagcaatggcatttaattccattcaatatatttatattgagctcctttaaaaatacagggccttgtggtgggtgctgaggacagaacaaaaaccaagtaatacatgaacataacccttgatttcatgatctagtagacctataaaagttgtcgatatctgatgaaaagaaaatggtaaagatattccaaacagtgtatgcaaatccagagataggatggaggggctctacctgaaggatgatgataagaaaaccgtgttgagtgaagggtgatttgtggaattcagataaaatatcagtcttgaatgctgagtgaatactcaatgattgactagatcccatggacagtaatttcttcaattatgacgatgctagtgtttatgactataactatcattctccatgccaggcactttgccatttggtaaatgtatagtgtgctattctaacaagcatgcacagagcttttactttaatgtatccatgagtttattggggttcagaatttaggtaagctttgcaaggtcgtagcatggagtaaaatatctgaaattcagacccatatctaactaagttcaaagactgtacagatatttctcctcctttgtgcagagaaggataggaatggttccatattatcatggacttagtcagatgttttaaaattataatgtcctgtgttaatgaagaagggatgatattcagtgcatattcttaaccgttactttgcttaatgctctcgacttttctgtgagatggatagtgtagataaaatccccaaggggactcagcaagtgcaagtaaaacaatgaaactttaaagccctttgtcaaaacctctctttttctcagaggatggaagggccgtaaaggttggtgaggaaggatggaccatttcctatgtagtcttctgacaatattcaaacaaaaggagagtcagcaaatcccccttgatgtgggaagttttaatacaatttgcagagtgtctctctggagtagacatcctcctctgcaatcgtgtcttctatatagcctcagggctttgggtaggtaatcctctccaaggagagtcctggagagggctgtctaccccccttgcaccatcctctaacattattctatagctcagctccttgtttctgtttcctgccttgtttttgtctgagtctgcaattatgatgtaagcaccatgaaggaaggtatgttgccagtgtttgcatcagcatatcccccgtgtgtagcagcgcaagggatatagtgagccctcaatgtctatttgtagaaaaaagaatgaacgtatcaacgaaatctgatacatattcattgtgtctgttatctccatctctcttgtcctgccttgttatcttgccattttcacaaaaggccccaaggcccatcatttcttgtgtaacttccagagtgttaatttttaaattaaaattaaggctttctacatgagtgtctattatttgagaaaccatgcaagatcgtgtgtgtgtgtgtgtgtgtgtgtgtgtgtgtgtgtgtgtgtgtgttgcactctatattatattgaattctggattttttcttataaataaaattttaaaaatagttctttaaaaataggaataagatgttttaggaggcacagagagcaaaggagaataaaaattgcaggtttggggttgtgcatactaattgccattgagtaaagagagcacactgaggccatttagaagagaattaacgtgttttgtttttgtttttgtttttgtttttgtttttgtttttgttttgagacggagtctcgctctgtcacccaggctgaagtgcagtggtatgatctcggctcactgcaacctccacctcccgggttcaagtgattcttgtgcctcggcctcccaagcagctgggattagaggcgcccacaaccacgccaggctatttgttttttttttttgtatttttagtagagacggggtttcaccatgttggccaggctggtctcgaactcctagcctcaagtcatccacccgactcagcctcccaaagtgttgggattataggtgtgatccactgcacctgaccttatttttattcatttaaaaatattaaatgttactgcatagggagtaatgggcttaacaatgaggtgaccaaaactcctatgtaccatgcagagcaatgtatcaaatgtttttaactataaacttctcaaaaacataaacctaattgttctgcagctgcaggttatatctgccttgtttgagcaaaatttggtggtgaaaatgccttgcttccatttttccttcaataactgatatggtttggctgtgtccccacccaaatctcatcttgaattctactcccataattcctacttgttgtgggagggatccagtgggaggtcatttgaatcatgggggcggtttcccccatactgttctcatggtactgaataagtctcacgagatctgttggttttatcaggggtttctgctcttgcgtctccacattttctcttctgcttccatgtaagaagtgcctttcacctcccaccatgattctgaggcctccccagtcatgtggaactataagttcaattaaactactttttcttcccagtctcaagtatgtctttatcacagcatgaaaacggactaatacaataacctatataattttgaaaagtacttgtctaatagactttcacaatagaaactatatccttatcaactttgaaaagtcattgcttaatgcctttggataactgaattttctaagattattttaattttgaaagttaaattttatcccagtgttgacgatttttgtatgctacttttaaaatattttgtcagtgatttatatctatggtgcaatcttgtaaaaaattaacaatgcaaatgtggctagaccatttaaaaatcaatatgttataattcagcccatttaatcactttagttaaacatcttaggaacaactcagttccatttgagagaagacacagttttctagatgtgtgttgtggcatcatattgctttacaatatcttacataaggtgaattcaaatcatatcattgaatctgttttaaattctgtcatagcttaagattagtgactaaatattggcaggtttatggaagtaggatgtaaacaagacaaaaacaagggtggaacaagtaattttagtatattattcacttgcacagagaaaagtcattcacaccttcttcagctttgtgaagaaaatagactaaaatcctgttgatatagcaactatgttttccgtttcttgtataaaaataaagaaaacttcctattaggaattagccagacattttaattttctctcttctttctctattttcccttacagtctctttgaaggcaggcaaaatttctataaagttttaagaatgttttaagatttttttattgtgaaatattcatagactcacaaggagttgcaaaaacagtacagagatttcctgtgtatacataacccaactttccccagttacatattaaccaaatacagtatattaccaaacccaataaactgacattggcacagtgcaatcaactagactgtagaccttacttggatttcacctgtttttgcacatgctcttttactgtgagtcattatctgttattctatgacattaaccatgtctatagatttatatagttactaccactatcaagataaagaagtgtttcatcaccacaaagtaacttaaaggattatttttataaagtaatgacaaatgtgtcaaaagccattcctgtgttatatagcaagtatgttttgagttattaaaactcactgatcatgtctttcagtgtcataactttgggtttccctccctaactataataatcctgatgaattacagttgatgaatatgagaatatccaactcttcctgactctataaatatattgactgagattgtaatatttatggtgtcttaaggggcgcttgttttattatgatgatgtgaacatgttgagaatagtaagaacagcccagtttagcaaacaggatatgagtcttctatatccagctcaatcgttgccccaacaggggacatctgcctttgctacttaattttccattctggaaaatgtgaagtgtatgagaatgaataatcgtctccgattttccagcacataataatctgaggagagcaggtacagcaatttaggagctgttttcttttggtttccaaaaaaagttccgtccagtggtctaagttagtcgtttactaagtgatagagcaattggctatgctttttgaacggactgataattatgtggatgcagcaaataggatatagacaatgcatctactccattacagtaaaaaagactctgatagcagttaatccacataccaggcacttagcttaggcacagttggaggaaatggaatggtaatagactgtagtatggcatgacaggagctgtagcttgagattcagaattccaactctgcctctcaatatttgagtcctcatggccaagatatgtaaagtgctctgtgcaggtcttggcaaccatccaccacacacttagtatgcaatatctatctttattagtcaaggatctggaaagctagttgatgagacaaatgatagaaacaagagttcattagatgaaataaagtaataaatgatgcaagaatttaaaaaagatttagagaaggaaagggaacagaactcacatgcaagtagagcaactgtgtatcagataatgtgctagctgagttagaaaccatgtctcatattaccctgaaaataattctgcaaagctgtaggtgttatttttttcatttgacaggtgaattcatgaaggcttgaatatagggttaagtgagttgtttcaatgtagttattgattcaaatcaagatctgaatgactctaaatatggtgctatagagatttgaagtaggataaataggatttgaaaaaaagaaaaaatatatagggaaaggaattggtacactgtagcagtgtcataaatgaagcttcagttgtgtgattccagatgatgtatgtgaggcctaatcaaacagctttgtggaatcaaaatttctgctcttgtctccaactggggacgagttggctcgggattaaggtgggcgaccttgggaagactagagtctaagcaggactttagtccctcataagaattatatgaggatgtatatttgcatacaaattcctgggcccaccgagatctgccaaattggaatgtgtggtgatatcacccagggaaacatagagagctgttataattagtcatgaaatatttagtactgaaattatagattatgttaaataatcacttataggggacatagcagggttggcaggttaaccatacagcaaacagggttgtaagtcagggcctagagaattttcaagaggcaggaattctgcagaatgaaggcctggtctcatgcagcaccatggacagctccgaggcactcttgtttctccaaaaacctgaaatcaaaaactttgcttttcatcatgcaacatacccatgtaacaatcctgcataggtactccctagtccaaaattaaagttgaaaaaaaaaactatactttcatttgaatacagttctcttcggctttaccagctctactctggaaggaatatcttttactcaatgaaaggccatcccctgttaatgcctggccaggttctccttatcagtcattcactatctttgtgtgtgagtgactaaacatataatgctatgtttagtggatggagtaagattacctttgcagaggttgtactggcttacccctttggttcttgtagttttcttctattagagttttttccatccctaggtttctatactgttcaaatgggtttaagattcttgaaggtattcctctgaccttgtaatttatgcttgtctcctagcacaacttttttttgtaaaggaggcaccaactatgtggtttgctggcgatggcatacacaaatcaggtgggaggaattaatgagagcagcaattccaatatctggttcttcaagattaacttgtatagtttaattcagcattctaaataagcctcatagatttaaaaatctagaataaacccacatttttaaaaaaagttttatgttatctgtgctgataatgcacgctgtacataataaaatattattttcttttttttaaatttattattatactttaagttttagggcacatgtgcacaatgtgcaggttagttacatatgtatacatgtgccatgctggtgcgctgcacccactaactcgtcatctagcttaaggtaaatctcccaatgctatccctcccccttccccccaccccacagcagtccccagagtgtgatattccccttcctgtgtccatgtgttctcattgttcaattcccaatattattttctaagtggcagtggaagaaacatggaaagttctacttcatccatcggtggattagaatttgtataccatgagatgattaattttcaaaaccagtttgaatctcacaaaataatgaccctgttttttgaaggacaaggcagaacaaggaactaggctgtgccacgttcaagtcacaatctctaacatttgttttgttttgttttgttttgttttgttttgttttgttttgtttaatctctgttgcttgttcactttctcttgtaatctgcattgatttgctacctggctatttgtagattgacttcggctgccaggaatggaatgtttttcataaaggaacatatgccttaatgaaagtaccataagaagggagtagagtgtgaccaattgcctaggtaataagtagtgacaacaatgatattattctagtataaatggaatcagtttttctttgcccagggggcatgataaagaaggcctggctggtatatactaggtgggacacaccaacagtgcctagaatgtcaatggatcaaacctgagggaaccagaagttgaaaagacatatcccaaaagaaagcatttgatgtttaagggttggcttacttagaacacaatgaaaaatattactaaaattaaaactatgattttagctatttttaaatatgacaaattaaatagcagaacattttaataaaacattacttaaggtccacaattttctgtaagtctaatacatgggtcattaaaataaaaaattccccatgatttatggaatcagatttttttaatacaacgaattctaaatggttttataatgccaattccaattaatatcctaattataacatgtcatccagaagggttaatgactaaattttattaatatttgttttctatttattttgatttgtgcagtttatgtgtatagtaacgatagctgcaaattagataccattagcattaaataaggtatatattttaatagaaaattaaagttaagtatttgagctagcctaaaatattcaacaacttaaatttgttttttgtggatcacatttttttgagacaaagtcttgctctgctgcccaggcttgagtgcagtggtgcattcatggctcactgcctcaaccatccaggctcaggtgatcctcccacctcagcctcccgggtagctgaggctactggcgcacgccaccatgcccagctaattttttgtatttttttttagagatggtgtttcaccatctggtctcaaactcctgagctcaagcaatctgcccaccttggcctcccaaaatgccgagattacaggcgtgatccagtgcactcacccctgtgaaccaccattaaatagctaataaaagatgcatgtcaataaaaataaacaacttactagaatgattatgtgaaaatcatttattcttccaaagcatgaattttcaaacacaccttttgttactgttttaagaagggaatcatttccatatatttgcatgtaaatcacttttagtctcagagaactttccataaaagtttttttattactgctgtaaccgatagagctagtggactattaatttaaaaagctgtacataaaaacacatctatagctcaaataatctaggataccttttagtttggggaaatgtagatgaaaatgaagtaattacagaatccttgttaattttcagatttagacagtctaggcaatatctttcaggaatgaagagatatgtgttttttggcatcttggtagagtatattcccattgtaattcttttgtgaagtctagaccagatgtggccataaaaatagacccctactacaataatatatttcatagataatccaataaagtcaaatcttattgcagtaggcttagaactctgtttgcacccatggaatttatatcagtttttggcaaatcctttcatctctgaggatactttttcatctcacatataccctattttctgaacattttgccttcaaagtatacctcatttatcaagaatttctctttattcatctgacttatacaagtggcaataacaacgtctggttcccatgaagtaaccagtgaccctttgaaataatatagcgctggaagaaagaaaaggaaagggagactgatcattcagcaactctttaaaaccatgtcaccgttaaacacatagtttattttatcttttttttagaattgtgaaaacctatattagcatcttcacggatgtctcctttgtttacatccccgcttctgtgccttgcctgcagtagaaaaaaaaaggacatgtgtatccctattccccattgtcttctcattctacatgagaatgagaattcttttaatttcttctctatctacatgaacccacttccattatctgtttgttcagttctttaaatgccctgaagctagctctgtgactgggcagttgaaagttctggacttagcatcaggttaatttgaaaaatacttattgagccaccaccatatgtcagccactactgtagatgttttgaatgtgtcagtgaacaaagcagaaaagatgtatgccctctggattcttgggggtctcaaatagtgaaagacagatacgataagtatattgtatagtatgttcaaaagtgataagtgctgtgaaaaaaaagaagaagggtaaaataagagatggctcatgctggagtacattccaattttaaatagggtatcatggtattcttcattgagaaggtgacatttgagcaaagatctcaaagaatgaggcatggggttgaatcatgtagatatcagcagtaaactcattttgggttcagtaaacagtcaatgcagaattcctaagccatcggtttatctgctgtttggggctggttatctgcagtgtggctagagtgaagtaagtgagagaggtttaggagagaatgttagtgaggtgagggtggacctttgaagccattgtaaggacgtttttctctttctaagtgtgagaagatgatgctgactgagaccagggtgataagaaatagtcatattctgaacgtgtttggaagtggggccaacaaggatttctggatgaattggataaggggcatgggagaaaaatggagtcatgaatggctccaacgtttttgctctgattaactggaagggataaagttgccctaaactgaaataataaagactatagatagaatggggcgattagggaggcattaaatttggatatctgttagacatatcaccagatatattgaataggcaattgaataaatacctttagagttcagcaaaaaaggtccaggttggacgtttaaatttcggaggtgtttgtataagataacatttaaagctgtgatatcagattgtatcactaaggaagaatatagatagaaatgacaacgtgactaaggactctaacattaagaggtggattgacaaaggagaaaacagcacaggataatgaaaaggaatgatcagccaggcatggtggctcacacctgtaatcctagtactttgggaggccgaggcgggcagatcacgaggtcaggagttggagaccagcctggccaacatggtgaaaccccatctctactaaaaatacaaaattagctgggtgtggtggcacacacctgtagtcccagctgctctggaggctgaggcagaagaattgcttgtacctaggagacagaggttgcagtgagccaaaagattgtgccactgcgctccaacctgggcgatggagcgagacttcatctaaaaaaaaaaaaaaaaaaaaaaaaaaaaaaaagaaaagaaaaggagtgatcaatgagatgggaagaaaaacaaaagtgtgtggtgtcctcaaaaactgacgttctattttcaaaacctacattttgggtctccttttactatatcctgactttctagctatataaccaaaaggagaaagcagtaatttttttagatataacatgttaataactctaagggtattcaatgaatctgaataattcagtggtataatgtgaaaaaatatagtattcataggaaaaggaacagaagttagctcaggaaatgacttgaatgaacaccgaagccaaatctccagcgcaggtccacgtattatttgtctcagtggttgaattagcagcaagattccttagtaggatgaaaaaagatgttgtgagcatctgtatctacatgactgaattaaattcctccaacaatgaaatgtagttaacgtagtatctcgaaaagaaccctaagtggaattcagggaacctaaattccaaccatggttttgctgctgactgattgcattcacttcaaatctatcattaacctccttgtgcctcattatcctcatttcaccaaataagaaaaatgaaatattcctccttccctacctcactaggatgttgtggatttaaatgtgtgagaagtgcttgagatgcataaaatttgatggagtgttttattcatgaattcaaggcatctgaagtaatttgaccatgatggacagttgcttccttgcacattttttagagtgacatttccgttactgacccacccatttatgcaacatgttgcctaatctaaatttaggtcaaaacaaattgaccttataggtaagcattatatctattaatattgtatttttgtattattttataatattcatcattcacctattttctcatgcaatatatgttactgaacacatatagattaaaaagccttcatccctaaataacaatgatgggaccttccatttttatatccctctggcatttaaaatgtgcttttatagccatcatctccattgatctctcagtcccttgaggttgatatgacagatatgctttttccattttaaaattacggaactgacagtctcagatgactttaccctccaactactgtgtgaagaagcagggtctggcactgaggtcttctgacatccagtgtagagcactatacttcacaatatggccattggcttactttattacaagcactaaatattttccactgaatacgtaatacctagaggagaatgtcgtgtaaaacagcagcagtagaacagaggattaaatgacccattttcttgaagttatcttagttttaaagggttttttcttcatcactaatgaccatccctgactaagaaattattctcataatacatgataatatctgcgttttccaatgcgacaagaatgttaggatgtctatacatgatcttgacaatccctagctccatcacaatgtgtccaaattcattttatttggctagacaggcatgtagtcttactttcaatggttggctctgctggatgctatgtgatctagaacctgtcacttaccccttctaaacttcaggaattttttatccttaagataacaagaaaactcgtacctgtttcaaagagctgtttgttcaatcacctatccattgattatcttctatatgccaaatgtttttctaggtgctgaattacaggaatgaatcagaagcaaaaagttcttactctcaaggatcttatatgctaatgaaatagatgttaaaaaataacaatttttgtttcattttattttattttattttgttgagacagagtctcactctgtcacccaggctggagtgcagtggcacagtctctgctcactgcaacctctgcctcccgggttcaaatgattctcctgcctcagcctaccgagtagctgggattacaggcatgcgccaccatgcctggctaatttttgtatttttagtagagatggggtttcaccatattggccaggctgttctcgagctcctgacctcaggtgatctgccctccacggcctcccaaagtgctgggattacgggcatgagccagcgcacctggcattaaaaagtaataacaatttttaaatatcaatatgtcttatacagaaaagtgagcagtgtggtagagtgtaactggaatgtgagttgagacataacaccagacagagaagccagagaaggacttttgtttgaggaaatgacatttgaaaaggaacctgaatagtgacagaggcagatacctaaagaatatgttccagacaaaggaaacaaaaagcgtgcaattgcatagtcaacttagcctacttgaggaaaagtgtgagtggattttggtgatggagaggtaagtgccaggagatgaagggagagatctggcatgcatcagatgatgtgcagtcttccgggacgttgtaaagagttgggctttttttgtttataaattaaatgttaagccattggggtttttaaccagaggagttatgtgatatgatctatagttaaattatgtttgttcttggatggagtgtgcattatgggaatttatacagaaacaagatttcacatatatatatatataaaactcagtgtcaatagaaaataataaaaacaaattttatccattgataattctggcattgatagtagtgggtatggtggtaataattgtgtgtaacactcaaactttctgaaaacctacacttgatctgtaaatccaaaagtatatgtagcaaaagccataatctgctcttatttctgcaccacttgcaccagtgtggagtgataaggcaaattattcaggcacctgtgtaagccttcagtgtcctcacccccttgttataactctccactaatattacattggtaaagacgtccctgacctatatgtcactgagacctcaaagaaaagagcaaagctaaagcgtaagggggaaaaaagccagcttaaaaagacttaaaggtttctgggaccaaaaaaaaaaaaaaaaagtctttgaaaaatgagaaaggaaggatagaagaaaagattctcctttggtcaatctggccaacctttggaaataaaaagtattgtgttgcagctaataactatttgtcactgcaggcacttgctgatgtctgccctttaaaatgacccaaactcgttggcctcgaaatcagaagccaaggaaaaaatcttggacataatgttttctgtagaattaccaattttctctctctctctctctctctctctctccctccctctctctctctctctccatatctatatatatatagatgtatatatattttttctgtaggaactaccaattcctatctatagggactgattgagaagtcccttatagcagtttttctttggcttttaggatgcaatgattattggtgagaataactctttcatttcacatttgtcattggcttatttgaatgtaatcctgattcaatcgttatgatctcctttaagtaggaagagaagctggtattacattgtaggattttaattttgtactcatgaaacttttgaaaaacattactcatactcttctgactgtcaaattggcctctaagaggtccacatctcaagaggtatcaagcattggtaactattttttggtgttgttttctcatcataaaatgtacttttattaggtgactttggaaattttattgaatcaatgcatgacactgcctcattctagtaatctgatgaagcaaagctgaaaaacaaaatttgaggattgtcagtatatatacttttatttgcagtcaagagttatgctgcaaaaatggtttattgaagtaacaaaattttagctgatatattaatctgaaagatacagtatacatttttagtatggaaaagatgaggaaaaggaggttctctttcctctaggtatctagagcaaactgtaactgtccttggtatttaatttttggctaaggtactgagattagaggtggggccttagatatgattaattgtcagactgataagctagatatttcattgagtttctgttgtgctctttctttcagatcctctgttcgatgctttgttataaagatttgggcatttcaaaatcttctccatatctggtgtctttccaaacagcaggtcatagactttacacaaagaggaacgacacaggttataagtagaagtgttttaaaccctgagttcctatttcagttttgctttcttaaacatattttccttatgtgataaatgcgagtgttgaatggtgataaataccacccataggctttaaagcctaaatgttgaatttgacactgagagtttaaaggcatcatgaaaatttctccagaactaatgttcaagcaatttaggttttacaggcaactcaatagttttgaatgatgtagttattttgaaaaagtcaccataaaacgctatgtttagggaattggtactttgcatttatcagaagattgtaaatgtcaatcgattggcttgctatttggaatataattttttaaattatagttcaaatcattaggatttaattcatgattttgtactacaaactaaatctatgaaaaatatcagatatttattttaaattagaggcatgtaaaggaaaatataaattttgaaatgccattttactggatttttctcttcagcccaccctaggcatttgttacataaaatatttctgaggaagtcttccactgattttgtaaacaaacatgttttattgaacagttctttgttgactagattaacattgaccattgtatgcaatgcattctcaaaatcttagaagctggttttctttttaatcatataattttacttgttttacagtgaaattaatgcatgtaaaaagtatacctatatagaaagttaaaagaatattgctaactagttactatacttccaaattgcctattttctgtgtcttgcattggacagtagtgattacctctaaaagaaaatggatggtctttgtttcattgaagggatggataatggacataactggcattcttgagcaatgcaattgcaaatacatgtctttgcatttatggtccaatcatcttcttactatgatagcatataattgaaggttcaaataaatgcctcgtcccttcctgtggcatattaaagagaaagaaaaattagaaatactttcaaagctacctcacatactaatggtagagttgtttgagtatttaggtgatttaacaaagctgatgtattttattatgcttgatcattgaggaaaatttatttatcggaatgcttttgagagcatatatattgtcagagataaacacagctggatattaaagaggtaaaaacagattttattcaatacctcgtgaaattaggggagagctgagatccattctaatttgtgcagaggcgacttggttgttttaaggcaagaaggagggagaaggagtgggggttcattcgagttagagaagtaaaaaagtacaaagggctggacagtgtaaatgtgattaggccagctgtgttagctggaagttattgaagttaggattctatcttcccacagagaacaggagacagaggacttatccttcttgatgatgtcatttgaaaagaatggctttcaggtccttgagtgagagacacttctgatttccaagagctacatgttcacaattgtaagcccttttgagtaaatgttctaagaaacggaggtaagagtcctatcaacagatgtgtgttggctagaacaaacattaaattttcctggcagcactgagctttctcaagcaggcacttaagggaaggctagggtcatcctagggacatggccttctggggctagaaaccatactagagtttagtcaagtcttagtgcaagggtttggacagagttgttaagtgctgagagttctgtatttctcactgtcacaaaggaagatcagaagctcctgatacttttttcatcagtacaattgaatatataaatcctatacacaaaaataaactaagcttatacaagcatattggtcaaggaatgttgctggccttattaattagatagcccagttaaaagaagaattttttaatataattaatgttaaagtaggatgatagtatataaaacgtgtctactgtcctgaatacaaactaaactgtttggtttagcatttacctcaagatctcttaatatcccccaaagggtccctaaaaccacaacttatctttgtgctcatgaagtagagaagagacagttaatagacatttctagctgatagactgttgtagagcagagaacgctctgtgtttttgaaaattaaacatatgaatttgcccctcttcccctattaaggaagaagagtttcttaattgtgcgaacacatcaagtgaactattcaattagatttttgtgacccagggtataaacatctggttaaggttacatatttcaaaggaacaaaacactagaaactcttggttttaaatctcatggctggaggataatttgcagcagagatttatctggcaagcatacagaattgctgagactgttctaaagatgtaagtgtgggtgtttgtgtcgtgaaaatagctgtttacatctattaagtggataccgatggttgaaagtgccgtctatgtcaagtttttaccaaatcaacttttgcctcactgtgtcagaccattttacctaatcaacttggactgctaatgtcctttcccctggcaccactatctgtctcttttgcaaagcacagaaacggcatgcatgattgtagtttataaaacacatgtaccaatgtggtctacagcttctgttgagttcgagagggtcagtttctgtaatctcttctggcacagagtcaagaacagcttcactttcctcctgctacctctctacccgtaagtgtgaacccatcactttgctaacactcaggaaggggattacacaaaatagagcaggagccctctgacctgaatatgcatctgagccctagccatagagcttctgattcagtagatctgggatggggcctaaatatttgcatttttaagtgtataagtgatgctgatgctgctggttccaggaccacattttaagaaatatcgataaaggtggagaattaaactgcagctcagaagacctgagttcttgccccagcttgacttttacaatctagcaaatggataaaactcgcaggacttcagttctcttcatctacacagtgagtggttagattggctttgtaatttaaaattaaacagggtttgattctgattcactacacaaggttccaaagaaggaatgatatctcctttcatttcttcactttgtcttctgtccctaggtaatcttatctatgttcctgatttaacctaactaatgtttctgcaaagcttctaatatttacatctccagccctgaaactctcatttgaatgctagtcttatatacatacccccctgcctaattgacatctccacttaaatgtatcagaggcaactcagactcaacaaggaccaaactgaatgttcgaccttgtccttcaaacccgatacacatccaggttcctccatcccagtgaatgacactatccagttaagcaagccaaaagtctggattttttttcctcactcttcctcactgtccgtcaactaccattattaaatctgtcacctggtcctactgatttaaccttctcaatatctctacagtttttctttatgcccattagtatcctagtgcaagctaccatcgtctctcattggaattaacacagtaacccccctacccaccagactgttctgcctacagatagtgtgatatttaataaatataaatctagccttggctagatttctccttcaaaaggttcacattaattttagccttaaaatggtgtgcaaagctttgcatagtctgtcctttgctatgttggcagtattttttactatccctctcatctgctcattctctgtactccaactacactaactttgtttttttttttttttagatttctctaactacagtgctgtaatctctttttcctttgcacgtactattccgtttgtcagggaatctgctcactgtctccacccactccacacactcacgttttcctgcccgtcttaccggtcttgatcggttgtcacttgctcaggaaggtttccctggtcaccccctccacaaattgaattaagtcctcttgctgcatgctgtcctagtgctctttattttcctctcctcatccttaattcagtttgtaattacatgttatttgtgtgaggatttgattattatctgtgtcacccactagatattgggcattctttacttactcaccactgaattcatagaaccacagtaattgtacacaacaaatattcaagagaaatttattgaattgatgaatgaaaagttgtaccttaacatgttcctgacatgtatccaaaaaagagctcccctttggggtctattaggactttggacctaggtaaacgtaaccctagtttcgctcaggtttaaacagtagaaagtaattgggtctcttttgcatgtggctttcctaagggctaaccctgtcttcggaatgagtcaatacagcagagctgttgaaagcagactctagcttcggacaacgttggtccgaatcatggttccgtcatttcttagctgtgtgatttagaataaattaatgttttaaagctttgatttcctcttccttaatctggagatgctaataaagccaacttcgtagaggtattgcgatgagtaaataagcataatttgctgtaaacaccttgcagattgcctgttgtatgctaactaatcaataaattgaagctcttaacatcattatattagatatttccagcattgagtatactatcaggcatgtggtagaagctcaatataaagttttgttaaattgaatagattccatatatggtatttctacagcattatgctccttatttaagtgtctctaagtattttttaagtatcacctcacaaaagacagatgtttaattcattacacatgtgaattgttttagatagaaaataaaataaaaaattcaaacattgaaatcaatagtgtaccttaccttaggattacaccataaaatttctaccaatcgagaataaagtgtacagtctatttcctttctaatacttttaacgcaacaaatgtttattgaacacttactacttctaatctatgacagacataaagatgaataaagcatgccacaatgtttaaaggagctcactatatcataagaaagcggattcacacagacaactctataagataaagtggtaaatttaggctggcctgtgaaacaaaggattataggtatagttaagaggtggaatttattttacttcgaggatttcagttacctttatattctttgtctaacctttcatgtttctctttcttcagaaacagagcacctttttcctgacacattcatttccccctatggagtagagcagttgttttcaaagtgtgggtcccagatcagcatcacggggatggttagaaatgcccattcttgagcctcacaacagacctactgaaacagaaattcttggagagtggagcccgcagatctgtgatcaagccctgtaggcaattctaacgcacactcaagttaaagaaccacgggaagaaaggtccatcctgtaacaagacagatttttttcattagcatcaattttgatcatttatatatatatatatatatatatatatatatatatatatatgcatgctcacaaaaccattcaccttactaggttttagtattccccttcctgtattcatgtggtatgtatgtatacaagatgaacacacatttacctgagacaaggtaagactacacatgtctcatttggggaccagaggctgtaatcttactcaaggtcaaagcgtcttcactgctttctttcactgcttttcaaaagtaaaatttccatgtaggtgtcatttgttttctttttgtgttttagaaaaccgattaaggggtgaagtctggctaaacttagtgtcaggacatttacttagataaaattattttaatttatcttgtaatgttcaatgtgagaagaaaagtccttatgagtagtgtattccttaaataacaacaatttaaaaactaccactgaagtctgtcagagtagttttgcctcatttgtctagataagagaaaaaaggttcacattagggattgcaatttgtctgccaaagtgcagtttatttattcagaaacatttagagaggaatgtgtcagttctgttgcaggcactgtgctgtgacggggagctcaagatgatctcaaaaaatttcacagatggggtgggcagggggcacagagagatgtatttagtggttcagatactatttagactgtggccagcatttctctaaatgcaatccagataacaccttacagaatcatctgggcagcttgataaaagctgtagactcctacccttcatcccaaacctattgaatcagtgtctgtgtgtgaagacctagattgtgactggtaattataccaaagtcttagaagcaactctaggccagtaatactcacatcagaatcagctggagggtttgctataccacagattgctaggttagccttcagagttgctggtccagtaactttggtgcaggtccagattttgcatttccagcaagttaccaggtgatactgatgctgctggccttgatcgtgctttgaaaaccactgctttagctacgctataggaaaaaccatataaggcttttatactggccaatgacttcacaggcctgaattttagaaagcccccttctgcagcttggcctatagattcgaaggaaacagaactaacacaagaaagctagttaggagctagttaaaaatcatcctgacttgccaaggaaaggtgctgaagacctgggtcacagagcaaatgcaaaacactaggactttgtccctagttcaccattaaatcaacttattttctcttaccccctcatattcacgtttactccttactttgtagtggttggacaaaaatcaaataaatctgagaattctaaaatgcacacccttgtttattttctaactcaaatatgccactgttgtctgtgctctgtcaagatttcaacacatctttttctcctgtttgcttttccttttggcatatagtgagtgtgtgtatacacacacacacacacacattttttttgactccttccaatgcccttctgctctccgcagatacacttctgcattctgaataaaaccgaatacatatatatatatatatatatatatatatatatatatatatatatgcacacatattttgaaaaccttatttgaaaagaaagctttcggaggaaacgttatttagccacttaatcgagtcttttactgagggactttttgtcgtcccctaacttcctgtcagcagtccacaggcagcaggaataatgtgggagaagatcaacaggcttatttcaggaggtcaggggccagtgccaccacctgcaggtggagacatcagaagcaggaagcagcccaccagctgcagggagaactccccacagagcctaaccaagatgaagggacttgtaaatttcaaccctcccttttggcttttgtgctaaaaatgtgaatattgaggtctgccctgattaagaactagatacattcctctttgtgactgccacacttccttagcgtattcattttttgtctttcgatctcaagttattattttcaaatgcattgcacgtatctaccatggataccattgcaattggaaggagcaaacgttttgtatgtttacttgacaaagagaagtgactgcccaagccacacagagttctgcacaaatcagtaacttctaacgaacgtttgcacttccgggcttgttctctacctatttcagtcgatgcatttgtattatttacttcaaactccaatactaataatgcctcaatcaggttgcaattgggatttgagcagccagaatttcagaaatttggtttggtccatatctgtgacaggtcagtaaatcagagaagcaagggtttggttgctattataatacattgcttacctatcaatttagttatcagccaaggtggttgttatcatccaaagtggctcattaaccaccttggagactcagtatacaattgcaagtaaccctggaagttgtaaataatcccaactgaatttgtatgagtttggtaaggttaagtggaaaccagctgcttagggccttgattataaatgaagttaggagtggaagaagtaacaaaaccccaggcaaattcattaaacattttttcccttcaactttatgctcacgaatgtgttgagactcttctgaatccataaaacacctttcagcatcatctgggcagcttgataaaggctgtagactgcctgcccttcatcccaaacctactgaatcagtgtctgtgtgtgaagacctagattctgactggtagttataccaaagtcttagaagcaactctaggccagtagtactcacgtcagaatcagctggagggtttgctataccacagattgctaggctagccttcaaagttgctggtccagtaactttggtgcaggtccagaatttgcatttctagcaagttaccaggtgatgctgatgctgctggccttgatcatgctgtgaaaaccactgctttagctaggctataagaaaccatataacatggacaaggcaaatgaaaaggttggaattcttctgaatcccaacacatttgtgagcataaagtcgaagggaaaatgattcttctgaatccagacacatttgtttaaggataaactgttttttccttctgaaaatttaatgtctgattctcgttcattcattcatcaaaagttatcaactatcaactataggtaggaactgtgcaatatgctggtgataaagagatgaaagacacagcccctcccttcaaccagctcctagttgaggtggcaagtcagctgtataatcaagtaattgcaagactgtgcactgaaaagggtgaccacagggtgtgatggccacccagggctgtggaatcagtcccaaaatgaagaatgaaagcagggaagggtaattcagaaagaagaaacagttcgcataaagacccatagataaacatcaatcagatgtggttaagacaaaagtaagtttctggaggctgaggaccttctcagctatatgtttgcagtgcttggtatagggctttatgcatctacatggaagacagaaagggccacatcacagtggacaaggcaaatgagaaggaggcagtatcagaagatgagggtacaccggagatcctagttatatatgggcattgtgttcatctcaggagttactgagtaatgggaccttgactcaaatgaatctcaagtctgtttttgcctaatcttggttttaggactaggattagcatacaaccgcactaggagcctagttatacgaaaggctgcattgcggacctgatacagttcaatatacatactgtcaccttgcaaatagggttacgttagttctcaagactgccaatcctctgtgctctaatccttttggcttttttttttttttttttaactgtctcactctgtcatccaggtgaagtgccctgggatgatctaagctcactgaaacctccgcgtcccaggttcaggtgattctcatgccacagcctcccaagtagctgggattacaggtgctctggcgccaccaggccctgctaagttttgcatttttagtagagacagggtttcaccatgttgcccagactgatctcaaacgcctgacctcaagtgatctgcccgctttcctttggcttttaacactatagagcaagggtccccagccctggggccacagaccagtacaggtcagtgacctgttaggaaccggggccccacatcaggaggtgagctgcagggccgccagcattaccacttgagctccaccttctatcagctcagcagcggtattagattctcataggatcacgaaccctattgtgaactgtccacacgagggatctaggttgtgtgctccttatgagaatctaatgcctgaagatctgaggtgcaacagttttatccccaaaccatcgcctcccacgcacctctccccacaaccccacccgcccctgatccatggaaaaattgtcttcctctaaaccagtctctggtgccgaaaaggttggggattgctgctatagggcgatggttttcacatttgatcctgcatcaaaatttccaggtgactcattaaaatactgattgctgtgccccactcgtaggagttctgataaggtagctgtggggtgagacctgagaatttacttttctaataagttcccaggtcatgctgatattgctttgataaccaaagcaatatcagctttggttatcaatatataaccaaagccacatagagggggagaagttccttgggtttagcccagtgtttactgcgaccaccaaaattgctggagcttaaccatggctcagagagttatgttctgttcactctgtaggctgctattccctgtcaccttttgaactatgatggaggggaagagctgccagctcaggagatttcacttttttctctgcataattgaaaatccagaaacacagggttttgggaaagctatagaacagatcatcagtgatcagtgtttaataaagtaaagcaataaactttactgtgtaaaataggatactttattatataaattttgtccccttcccccacctcacaggccaataaaataatatacttcttgtccctgggtgtaatgttattggaaacctttgaatgtaggagaggcatgggcttgtaagttgcagaaaactgctagcctaggattgagaatttcatggataatccaaaaatagatgattttacagttataagccttacgtgaacttgaggtaagaaaacacaatgcctttatagtcttctcagttgctccacatgccctctgagattctgttctgcccagcctctctggttgtcacatctctgggcattaacagaaagttcacatactctttgtctctgatgataatccttctaggtccatatagaagatccctatccaaaccatcccccaaacaaacctattggttaaatattttctccaccgaaggcactttcttagattctaagtgccctgtaggcaggcttcctctctgatttgggagagtacaaattgcgacaaggttaaatcatagcctgggaatttgacctaaaattcactcttctcccatatgcattcatgaaccttctgctggtttttaaaagaagctacttaatgtcagctcgaagaggttggaaggggttaaaaacatgagcatggcagtaagaagatttatgaaggatctgagaagattatgacttgatcagatggtattttgtcagctagccacatttgtgaagacttgaaaactagggaggcttgtccttctaagagggggcactgctgggacctggattctgtggaaccgtattagtagaataaacaataacctttgcttgtatcaaatgaacttctattctcatgtgtcttttgacatatttttattaatcatatcactgggacctccttgctgaaagatatctccgttccccattctgatgactcccaactaggagtgagatcaaatgaagatggcatggaccatttctccatgtgacagctctctgtggttgccttttaacacttctaatgccctttctcttaagaattcccatttgtcgtctggcactggtgctgtgatcaataaaaatgtaatggagtgaggcttagaaacatgaggaaatttactcaagctatccatttattgatgtgtccatttgtgttgtcagggaagaaaaactttttcactcccctcttaggttcattacttggggggctgcaaattaaactgacgacagatagattggcaatagaaaagacaaagtttattcagagaagtatgtgggagctcacagaaaacatagctcaatgaagttagaatttggggcttatgtactattttaacaagggttttgaaaagaagagtgttagaatttcaagccacaaagttggtgggaaatatgaaagaaactaatgaaaggtaatgtttgttttagtaaagtctgtttatgtaattttcttttcccagcgacaacttctcatctctggtgacaggagtcactctttacccctggtgcaagaaactttccttaaaggaggatttaaaacagttgaattatttcagaaatctttgcttttaggcagatagggggagtacagaaaaagccccttcccgtatctgttgatcctcaaatggctttagctcaaaacaatttttacatcacgatggcataatgtagatctcttcaatgtgttcatttattccacagatatttgtgaagtacatgatatatgccaggtacttgggatacaagaatacataagtatgtccctagtctcgtagaacttacactctagtagtgagctagagaataaatgatattatttattatatgcatacacatatgatttcagatagtgatccatattggaaataaagctggttaagggaatagaaaatgatattgaaggtggacttgtttagattgggtggattggcatggcttctctagggggcagtatttgagcagatatgagagcagatattctccaatttgggcaaaaacattccaggcagaggaaacaagggcaagggcactgagttcaaaagagacttgacctagccaacaaatagcaaggattccagtgtaagagaaggtggggaaggaaggaggtgcaagtataggcaagggcaagatcacacgggatcttgcaggccgtgataaaagaatttaactctttcataattttgacaggacatcattgaagaatttagaaaaatagagtggagatacctgatctgctttcttcaaagagttcattcatcattgctgagtagaggttagactgaaatggaagcaatagtgaatacagggagatagcacaggaagccacgttactagtccacatcagaggtggttcagactagggtggagtggtggggtcagttagagagctggtatttaggatacattttaaagacaaagctgacaggatttgctgtgatgaattagatgtaaagtatgagaataattgagaattatttctaagttctttgctggggaaaagtggaggaggaaaaagttagggtacaaggtgtgatgaaatcaagagtctctcttattatcagagtctcattagatatccaagtggaaatgctggaaagaaagttgggtagatcagtctgaagctgaagacagatactgtgactggaataataacgtaagagttggccggacacagtggctcactcctataatcccagcactttgggaggccaggataggagaattacttgagcccaggagtccaagaccagcctgggtaacacagcgagacctcgcctctacacacacacacgcgcgcaaaaattaatcgggtgtggtggcacatgcctgtagtcccagatactcaggaggccgaggctgaaggatcacttgagcctgggaagtcaaggctgcagtgagccgtgatcacaccgctgcactccagcctgggcaacagagtgagaccctgtctcaaaataaataaataaataatgtggcagtcataggcccttagatggtttttaaagacatgggactggatgaagtcttctaggaggagagtttgggaaaagagcccgagaattgactgcacctttcaaaacaggaggaagaaaaaaaatactcaaaggagacaaaagcaacttctgtgatttatagagaaaaccaggcaagtgggatgaagaaagtccttcatgatagaatcaaaaacagtgtcaaatgttgaaaatacaattagacaaacacaaaagaatagaccattgggttttgcaatatggagctcatacttgaccttgataaaagacattttcactggaagcatgcatcaaaaaactatttgtggtaggttaaaatgtagtaggaggtgaggatatacagacagtggctttcactgtgcagatactgctgctcatgcactaattaaaagacatttgttgagtatctactatgttgtatccattgctaaatagtaacagctgggtttagtcaggtagaacagcatcaaaatcattatagtatcccaagataggtacagtaaaatctgtgaaggaatcagagtagtctcttctccaacagagcgtaagacccagcttcacggagaaggtggtagattagctcatctgggaggctgagtagaagcttgtcattatagagggagaacatcagaagtgtggacaacagcttgaataaccttgaaaggacaaaagaggacggtctgccctggaaatattaagaagtctcacatgattagacacaagatattaggggaaaggcataaggtgaattgagtcaatgaggtcaaagagaagctagctggaggaacaggcgatcataaaatgagtaaaagtatatattcaaagattctttttagaagggctacacaggatggataaggggagagagagagttgaggcacagagacaaattggaaaggtgcaatcataaccagagacatgaaaaacccatagaaatctgatgtagattatgtggtccccaaggttgaacaattaagtacgctttcagttgttatgcccatgatattaacatattttataactgcaataagtgctgaagctaaagataaatacaaacaatgtaattcttattctgtgagaaaatgttgtagctggaagttaaacatgtttcttagctaaagaaaaatattgtgtgatctggattacttaatgttataatttagcaacaaaatgttgacattgagccttgcataatcaaaaaagtagtctattcaataaccacattctcagaaaaaaaacaagaaaatattagaaacaatgataaattatcgtagtaatttaattcagtattctattgttttatttggatttaggaaaggcagaaatgttgaaatattaatatatatccctgtaataatataatttgtgtctgagaggtaggaatgagggcatgaggtcaaagtttgataatgaacttcaaagctataactatgatcaggaaattaaaattggacaataaattcctagaatcgtcaggagttgcttgtgaaatcgagaaaggaaaggatatacacaaaaataaagaacagccaatgctctcaaaggagtctaacttttataatagtcttctgtgttagagctgaactcttctggtttagaaggacactctgttgcctggaaatagggcatggaaaaagtcatcagagtcatgtcatctttcattcttcccatgaacgaaatcgaggccctgaaaagtcacctgtgtttgctgtattttattgcaactaagatgtgcatttttaaattgatacataataattgtacatatttgtgggatacatgtgatattttgatgcatgcataccatgtgtaattatcaaataaggatatttctgtatccgtcacctcaaacatttaccattgctttgtgttgggaacatttcacgtattttattatagctattttgaaatacaaaatagattgtcattaactatagtcaccctactggatgcaccttgtttttaatatttctgaaaacagatacgtctcataggtgatggtgtcacagctgtgcattagttattattgcctgtgcaggtgcaaacgtaactattcatattgttgtcaattaattaaatagttacatttatttatatgcgtttattatactaataaacacaatattgagatagttgagctctagttttgactctgctgttaactagctgcgttactttaatttacttaactaatttggctttcaaattcctgataagtaaaattacaacatgagtttctcctgctataatagcctgagaaatcggtgaaacacatgaattcagatgttgatgctatttaatagcgggattccagatatctacttgccattatgggagggagagaggaggtggactggaggctgtgatttccctaggaggttgttaaaattggccaggtgaggaaagctgagacagaccataaatatgaagcatgatacctagccctcagtgttgaaagaaaatcaaatctcatctttgtggtctaaatatcagtatgatacaatcctctgtgtagacatatcctctgccctattgttttctttctaaaagctaaagcccaggtgtgatcacatccctccgttatttacaaatttctgatgatgatgattcttctaatatctacattccttaccattaccatgatgtccaaaacctattataatctattcgtctccaagtgccatgttgtggtcaccctatgcaccctctaaacccaccatatgaccttcccgctgctacttgaatacagttggccctctacctcgttgtgtctttgcattgcctatttaattgcctttccattctctaaatcactctttcgctggaccagcaacatcagcaccatctgggaattcattagaaatatagatcctcaggcctcatctcagacctgcttgatcagaaacattggagagtggagatgagcagcctgtatttttatcagccctctaggtaatttgatgcacactaaagtttgagaaccactggtctagagcattcttctttaactctcttctaaaaattattagaatgaattcgagggacgggatctccttgaaagccaagaacatttctttgtcatctttctgacttcagggcgtagtacactttttggcccataattaaagctcgataaatgcattctatgccaataaatcagctaatcaaatatattattcatgcccttgaggtatctgaaatttgtttgcagaatgtaatatataactatagagtaacaagagaataatttattgccatagataataaaacaatatcctctgtataataaatcctagcctctgctcaatgggcaaaaacgggactggggtttcagattttaaaaagattattggtaattaaatcacctggagaagcacttgctgcagagatgggacttgaagcatcataataaactgttgtttattatgattcggtcagagctgatggaatcacagggattgtgtgaggtatggaaagtggttgacattgaattccaggctgcacagttgggacttgatatgataaccaaaaagaaagaatgtctggggtggtagcaagctctaaatttagacaatctaggcttatcctaaggagaatatagatacagataactgaagtttgattaaagggaacctggtgtatcacaaatagtaaaaagctgtagttagtctatgcagctatcagctagccacataatacttttgggcaaatacattataaaccaaaagaatgacatggcttatctctgtaacaaagtggctcattgttctttattctactgttatccttaagaaaaaaattttagtaaatttgttatgctatactcaacttcaagaagggatagcgcttataaaaaaattgtttaaagaaacaggcctatttctctttgggagaagccacggagaaacgaaaagaatggaacgtgtgtttctgcccagatggcaataaaatgtagggtaaatttctgtcttttaaaactgtattttttccatccctctgtatatacacatatcctaggactgttataaaatgctgcatgcgtatgtgaaaatggaaccttattgggctgtttgatggacctttaaaatatatttgttggtttggggtacatactagctatgcaatataatccgcattatttcttatgtaaacaatggataaactgtttcacagtccagacatttatttggtcactgtttgtagaatgtctattttatttacttctgaatttgtattccagagatctgccttcaatgttggatacttccactgtaatattctaggagatgctcactttctttttcagcatctgacacagtaccatctgcctcctcttttcttgccacaagtaataacaattttataaaggaggatcacattacagaattataggtggtaaactttctaccaccagatttacccaagaacctgaaacacattttttcaaaaggaaatagaatgtccttcttgtgactacatcggaattttgcttgcagcattatgctttttttttccccctagtgtagctagccatgtggaactgaagccattagccagctcctcatcctataaatgctattacctgggaaaagaggcagaaaatatactctcttctccagttagagtctaaaggaagagaacaatatgggtagttgtgtttaccacaaattgatagaactcctttattttaaatgctaaaaccaaataacttgtttatatgacttcaacattgactatcacacactgttgcatgataacagagtgaaaactacctctattggatttaagtggggaatctatgtctcattctcattctttttttactgtggaaactagttgattccaggatcagccttagctccaacttgccacactttgagttttggtttttcacttgcattgtcacaggaaacttctataggataaatcgaggaagattttactctgcaacgtgttgcagaattaaacatttaaagtggcaaaaccttcgtgtgtaggttgtctccccagagaatgtaaaaatgaattgaaggcagcacctaataggtaaacgacagccaatcaaacaagaacaaatgaaatttgactggcaaaatcaaattgaaaatgtataacgctgaatctcagaatataggaggatgcatagaaactaagctgtactattataaaagtcatagccattgaaaaataatgactggttaatttggttttctttacctcatggatgtgaatggttagattttgatgttggtgttatttgacgtgtgtttgtcaagaagttgccttagtcggctcgcatttaggataaaaaaaatattttaagaaatgtttaagagattatgttggagacattagaaacaaaataattatgcagagggcaggactatcaaaatataatagaaaaattacaccgctcttttatgatttcctcctttttggcatttaacacaaaactttatgattacacacaccacgcactccagaaatgcttaaaggaagatgagaggaaaattcaatagaagtagcaggcatttctgtgaggacagcagaatgatcacttcatctctgtattttttttttttcaaatttctgtatctgtacaatgtcttttccagctctaatattctgtgatttggtaatttccgcactcagattttctttaatgaattttgtatgatattacctatttttataccagatattacctggctctaatttctttttcaccctaggaaataaaagtatcgggtgaatttcccattttcttatgttattgatacaggtctctgttggatatccccacgattaactttcctgcagcatgttcgatggtggcttaaagaagaaaccatgtatcagagccccttgtctatatagacttttagataaagagaaatacatatcacagaattattctgggcgcatagagtctctaaatgcaaaaaaaaaattgtattgtagctgttgattcttctcagatagattgagtgtagagagagagcattccaaaaactgagcagaagaaacacagtctgaatcaaataacatgaaattttagctaacaagtaaataacacttttttcagaatatgcaaataatattggtttattatgaaaaatgtataggctgatagatgagcatagagaaaaaattataaatatcttctttaatatcactttccccagcaaaccacttttaacattttgatacattttcatgttcaaacatttcctaatagtcttttttcctgttatataaatatgaattttaaacattcgtatgtttatgaaaaggcaataagatactgctcttttataacaggctttctgaacttcacaacatgcagtgtattctaacatgctccttgtgttcttaactaataaaaaacctcacgttatttaaaaaaccatcttaaacataattatccattaagagaagaggttggggtagagagtttcagactatcaatatcaaagttatattttctgtaagtattttaatttttaagtgtagctataggtatatgattataaaaccaatagcagagaaaagataccacctttgaatatagttttccttggttccatgaaaatggcctcctttctttttgccagtccctcagtatcattaactcatttttctgtaaatgccatcattgtatcacatgtcctcaggaaaaggcacttttctcttttaagctagtgtttgttcttgttctaattttatggcaatttaacgagtaacaatcctgtttctataaatactgtttcctaattaatctattgcattctatccatgagaatttagatgactttctttgtaagagaaatctctgtagcatgagattcttctttgctcttaaatttcattctttcacatttttaaatgacctgatagtattttgttgtatttgtgctgattttttttaaccaatcttaccttgttgaacatgtaagttgtttctaatatttgcaatgatcaaaatgtggatccaacttcactaaagcgttaagaatctaaaacaaaacaaagaacaaaaagttggctgtcatcttgcttggaccaccccgtgagttactattttcttgtttccggtcacagttcatcctaaatcatttcagtacacaaaatgttttttaaagtttgggacagggggtagagaatgtcaattattcctccaaggcagtcatatgagcattgagtatcatgtggaatagttgttacttgtaaagttatggggcatcaaacccagtcaatatgtttctggaattgaaaaagtccctggacattctaatgatactgttgttcactttgcacctactgttaccactactttgatctgtcaacactgcccgtaatggttaattttgtgcatcaacttgactgggctacaaggtgcccagatatttggtcaaacattattctgggtgattctgtgcaagtgttatcagatgagattaacatttaaattggtagactgagtaaagtagattgcccttcctaatgtgagcagacttcatgtaattaattaaaggcctgaatagaagaaaaacactgaccctcccctgagcaaaagggaatcgttctgcccgactgccttcaaactgggacatgggctttttcctgccttcagactttaaccacaatattagctgttcttgtatctcaagtctgctctacttcgattggaactacactatcagctctctcgggtctccagcttgcttgttcaccctgtataccttgggagttgtcagtctccatagttgcctccataattgcatgagccaatttcttaccacatacaaacacacacagagacacacacacacacacacacacacacacacacacatataattatatatgtgtgtgtatacatattctcttattccttttgtttctctaaggaaccctaatatactccttattactctttctactgccttagagatcttcaaggccaagagcgtaatcctccatcctggctctttttcctaatcattaatgatcaactcatagccatttagctcaactaaaaataatttgttcatgaagctttacactcccacatactgaggaacgtggtacctaagatcaaacagtcactgcctcatcaaatgcattcctcttcaaccccatacaaatgtccccagatggaactcacaccataaaaatattagatcccattgacttttctgctttctcaaggatcattgcagagcttgaaaaagatggctcctccctttgcctaagcaggttaacttggtgtaaaagtacatgtaagatttggcacaaaggaaaataaatcagttttgcctgggtcctaagaaacatttccctctgcctcatggtaattgtacctgccagttgattgcattactcaagtggagaccatgaagtgaagtggtagaacaagaagaaatccctataattttattaagtatggtgaaaaatacagatatgtagagaaatgactgggattagatggagcaaaacataattcgagatcctgatacaaattgtacttcctggctcaagggagggagcagaacattccctgctacatgggaataataataaatgcctgataaaaatgcagatatatcatagactacagaagctgaagtggattcttatggtcccctactcagacagcctctccttcagatgaagaaactgaagcacagaaagctcatcctagtgtttcatattgaaaaacccattcaagtctattttaataacctgttaccaaaaatgagggaaataatttaactttaatgtttcactttgcattacccttttcctgactagacttctatccttttcttgagttgagctcattaactactatgaaattatggttatgggtagaggttaattttatacctgtccatcttctggcatcttatttacactaaaaatcatttttaaatggcttcattttaaaaaatattatttcagttgacattttaaaagacacatcatttatgtactacagaatatgcattttatactctcctttattaattttattattttccaggtagaccaatcaaatgaatcagaaattcttggttagatctattagacagcataagtatgtttttcatcattaaattaagatgaaaacacaattttactttaaagtgtttgacgtttccagcctttataaagtcaacacttaatcacatctgaaatttgcaggaaaaaattttgaaagccttcaattattaacattatttcgggagaaaaagccactttgccgcagaactttcacttttctctcgtgaattaagtctgatacaaattattcattatggtgaagtttaaacataatagagtctagctacttccacaaaaatactattcaatgagtttctacattgacatctaactgaccttgtaattaatgttgtacacgatccttttattatatgctggattatcaaatatgacttattagcagtataaagacacaaagttctgaaatgtaatttatagccatgaaaaggaactgagctttgtgtgacagttaaatttgaagagatcaggtgattattatgaagcatgaataataatgcatattaaactcacgtttttgtttaaatcattaatatgattgttttagaagaaagtctacctctatcatatgggcaataaaatgtgtataagagcaaacatttgtgtatgtgaaataactcaaattaaaaccagttttccacattaattcttacagtttttaaaatttaaatcatttaatgtatcacacatagctttattcattttaagctataaatgttacaatttctgtttaagctgttaatataagctttgtaagagcaattctgtataaatatagaattgtcattattcactaatagctaccatttatttagtgcttgttgagtgcaaaagtactgcactgagatctttgcatatgttctcttaatgttacaattcttacctgaggcatttctgtttctgctggaatatggtctctctgaattgaacaagggaggcatttttggttgttatgatgaaaggtggacactgctggcactaacgtgtgttggtaagcgactagactcttcatgatgcgtaaacagtgtttcctcatacccctgcacattcaaatagaggaaaaccttgtttatagttaatttcccctagaatgtaaatccatttaacatataaacacaaagcgtgttttgtgtggatgttttttactggagcagggagacaggagaggaaatgcagttttgatagttgctgaatttttcaagaatgcagcaattatagaacaatttctagaagtttcctaggagctcttttccatagcagaaaactaggacttaatagccttgcgactcatggtacttgagtgttccatacaactcacctatattcaggggacatttgaaaaattctacattaaaggggattcttaacataggcgcaagtgtctggcatcttcaataggtcttctggtgtggccatgaaaacattcacacgtttcaaagtattttaaaataaaataaaacatatattgttgtgttatgaattattttctttcttttttatatgatggttagatcactgtgcagacaagtttatgagatctattcatttcatttcagggtggtaaatgagggtgttactaaatgttggttctaaaaagggagacattgggtattacagaattcagaacagctctaagccctgtgcacatttagcattagaggacacaggcaaatctggcctccagtcctggcagcttcttcactatgtatatgatgttgggtgggttgctttacctctctagtttttacttttatttctaagctagggctattcatagttctttatcatgtggttactgtgaagtagcaaagcacctgacataattagagcagataaaatgctcaacaaatattgcttatcagaaggattatgtattacctcccgaaatacatcaaaaatatattttccaattcaaagaatatgtagtacaaaaatcatgcctaaattaacagagttgcagtagcccaaggagagaagataatcattattgatttcttcttcctttttgctaagcagttctctgtctctgcctcctcagttgttgtccatcccactcccccactcccaagccctgaactctgaggggtttgctgccgtggccggttctgtagtcattgctgtccaatgatgaaaacacaaaatactgcaacagaacactatgcctgtcagcttagctcccttctttctgctaaatgacactcaatcctattcttttgttctaaaggatatcctaaatgaatagccactggggggaaaaaaggttatataagattgtgcactgtgtgaaactgatgcaaccagatcaatgatgtgaatttctcttaactatttactgggatctagaaacaggtctctcaacttagcagtgtttacgaatataataggccttccttatacatacatctgaagccaatctgagtcaggaagagtcgtggtctgataaatattttgaaaacttgcatttgttctattaaagcaaactgtttattaatagtgtgccttattttttaaagcaaaacatttataaacagtagtcattacaggcacttcagtgtacggagtgatcaattgttagacctttaggaatcgattgtttcgtggagcttcggcttataattgaaatgtcatcagaaggagtgtaagacatagcttcaggagaggccatttatgcgcttttgttttcagctaagttatagagtcatcatgtgaagaaagattcttctcttagtaaaaatcctttaatggttggaataacacttgatatttaatatttctttctactttatatccacatttattcaagtgctaacgcgtgtggggcagcaatgaagcactttattccaacattatagttctcatatctgcgtatgattatttttcatttatcgttagcatatatataatgatgacttttaaagtacactgtattatattcactggaataatgattagctattaataatttgaacactatccaggaaattactgaacatgtcctacaagataaacctcgtatgatattgtctccaaataacagtgctaaccaagaagagtgctaccaagttcaaaagtaatcacagggagtaacctaaatgcagctccgttgggttaaaaatagtttctctaaattatatgttccctaagtttgagatcgatttctacaaggggataaaatgtttttataaattctcagtgataagtcatgtgattaagaacccccaactttttttccaaagacatttgcatctctgatcaaaataacaagatccagtcttagttataaattggggaattttcatcaaaataaggagctactcgttgcataagaagactagtacaacttaaagccaatttaatttcaatgaatgcatgatcagctccattgccaattgagtgtttttcttattcatcagaagatgggttcatcatcgtgtttcatatcaactgttctcaaaccatattgcccatttaaataaatatagatttgtctcgaaattctaaattcatgtcatatttcataaatagcctatggtcctatttattactttaaaatattatagatataatatttttattctaaagtaactgtgttatacaaccaaattattcatttaaatatgtgactttttaaataagtaaatgacttatttaagtaaagtcattaaaattttccagtctgtccttcatccacctgatctttgaatgagttaggaacaatacaggaaactaatacaaacttaattttgattacaaaagatgaaatcattctgttatttattcaacacactatgtgtcaataaaatcttatactgtgaaagaattcgtctaagtccatttgctgttgcttgtaacagaatacctgaaaatgggtaatttacaaagaaaaggagtttacttcttacagttacggaggctgagaagtccaaggttgaggggccacatctggtcagagccttctcccatccaagtactaaccaggtcgaacctcacttagcttccaagatcagataagagtgggcgcgtttaggctggtgtggctgtagacttgttagagcctttttgctcatggggacacagcagagccctgaggcagtgcaggacattacatggcaagaaggctgagtattctaatgtgttcatgtctctcttcctgttcttataaaatcatgaatcctactcccatgataacccattaacctattaatttatgaatggatgaatccattcataagggcagagccctcatgatgcaatcacctcttaaaggcacaatctcccggtgctgccacgttggggattaagtttccaacacatgaaatttgggggacacatttaaactatagcaaaattgtaataaaatgttatatagaagcaatgttcttactgattataattgttatattggtaaagtgttaagtcctctaaccaagggatatatttcagcttattataatagttttaaatttacaattcaatatgaataacatctggtaaaagttcttttcaagaaatgggaaaattagaaatgtttagaagaaaataattcaataaatattaagttcaaactggattcatagtttatgtgaaattctgggaaccaattgcaaggggagaaaatagttacaatagcaatggtgaggatgagaataagagcaggtatcaacgttaattgagggtgtgttatagttctaatcgtgctatgcccactacatgacttttccctgtgtgaggtttccgagcttcttcgtagtaatcctaaattgagctggagagaggctagggtaacttactcacgctcatagagccatagagtagtaaaacctgtatttgaactctggcctgtctgacatcattctgtggtcttttaaaccaccactgcttctccatattaaaactccaaatctaggtgaaaagaagaaaactcagaacatgttctgcaacaaaatataacaaaatataatgtatataaacacttatacataatatcactaatatctttactatgaaaagactctgatacgaacattttacataattcatgcagaagtgttaatcacattgtctgtgatgagctgtgtatgtatctgataaaattctggcaaccagacatcaactcgtaggcatagatctgtaacactaaatatttgcctcgagaaacttaaagaaataaagacaaatgaatgaataggaacatggaactgagtacaagataaaatcctcctaaagcaatcgatgtacttgctgctgcgttattgttctaagcaaaagaagcatggcgaagggagatgtgaagctaaaaacagaatgcttagaaggagatgatagcaggagggaagcaaagatgggaccaagctcccaaaaggcgggctttgaacaaacaaaacagaaagctaagcctttgacggatgcacgggatgcaagaaactttagtcaggaaagaggaggcgaagaaaaaccctccaaagaaaaggtgaacaatattttaataggcaaattgacagatagcaagagatatataccatgctatgttttctcattgcagctgaagacaaactggggttatttatgctttgaaaaagcgtaaatctaaaaaacaattgtggaggaagaagcgatgaaaacacgtgttaatacagaaaacatggctccaaggctttaaacttccttgtgagataaatgcatttacattttccgtagtagctaatatatatatatatacatatatatatatatatctgggaaaataatacacagtgattttctttctttttttcatctacttatgtgagaaaaaagtaggctatctgaaagcttttcagttaaatgaggaagaaagttaggtgatcttgtaaataatatatatgttcaagataatgtaaggcccttgtgtagttttcaaaacttatctttaatagcagtttcttctggggatggggtagttcaaagttgaaatgttagaaagatgttaactttttttcctttttacttctccctttcaggatggaattaacaaatttgattacaaatagatctcagagagaggcaaatgcattgaatccagaagtaacataaaattagatcatgtttagttatgcccgaggtcacatggtgataaaaatgaggataaactgaaattgtctgtgagccagattagtttattttatgccagtcctaggaaaaagacacatcatggtaggatacatcctttttttttttaattatactttaagttttagggtacatgtgcacagtgtgcaagttagttacatatgtatacctgtgccatgttggagtgctgcacccattaactcttcatttaacattaggtatatctcctaatgctgtccctcccccctccccccaccccacaacagttcccagggtgtgatgttccccttcctgtgtccatgtgttctcattgttccattcccacctaagagtgagaacatgcgctgtttggttttttgtccttgcgatagtttactgagaatgatgtattccagtttcatccatgtccctacaaaggacatgaactcatcattttttctggctgcatagtattccatggtgtatatgtgccacattttcttaatccagtctatcattgttggacatttgggttggttccaagtctttgctattgtgaatagagccgcaataaacatatgtgtgcacgtgtctttatagcagcatgatttatagtcctttgggtatatacccagtaatgggatggctgggtcaaatggtatttctagttctaggcccctgaggaatcgccacactgccttccacaatgaacagacacttctcaaaagaagacatttatgcagccaaaaaacacatgaaaaaatgctcaccatcactggccatcagagacatgcaaatcaaaaccacaatgagataccatctcacaccagttagaatggcaatcattaaaaagtcaggaaacaacaggtgctggagaggatggggagaaataggaacacttttacactgttggtgggattgtaaactagtacattcttaacatcaatttattcctaaaagcaatgttcatagggcacactgtaggccatagatttgcctcacaaatttaaaggcctaagccctcaacatgcacagcagtatactcagagactatttgtaaagatgacgattctggaactttttaatgaccccaatcattagcaatgattaaaattaatattcaacattctatatttaccaaggcaataaagtagactaatctattttaaaagggttttaaaatgaagagatgaaacaaaccaaatgattttgatttaaacttcatgaaaacataagttgcattaatcaggtgattttgttttatgagcattctgattgaagtgatcatatttagccccgggagaataagagaaggtaaagtatgggtatggcactgaatttactgagatgattatattgtttgagttaaagaacttgtattaagaaacaagtatgtgccaaacattgtgctaggagcaagcaatgctaaaattacatgggtagaaagagagaatgaaatatctagaatgagttagaaacatcagtgttttccaatgtggagccctgacttcacatgaaaattctcattttcaaacaaggtagtttatgaaaactggactattagcaagacagggtgggcatgccatcagtatagtacctggtgtaaaactagaaattttaatcatttgtgctttcattttataatcagtaaaatccaaggtaggacaaacttttactttttctgtataatggactgatatttgaattatacccaactttaattttttgccagaaattatgctttattgtttctctaaaatggtactatagatctttatttatttctatatatttatatgatttttacatatatgtgcatttacatgtatatacatccataaactatatacatatatacacataaattacaaatatgtgtacctacgtacatatatatgcatatatcacgcaaatacaggcacattttcaatacccctttttgatttttttccttgaagagcatagcatctgaatttattatggatttatttttaatttatggtcatgttctttgagtgcttttggtgtttatctggttgccccaaactcgctagcattgtaaagaagatgtgcaaagcctgaatctagactgactttcatattgactttattagtcaaaaaaagtagatgaaaatgtaacagtccgtgttaaaaatgggaataagacagatgttcaagccctagcttcagcagtttttagctgagatttactggaagaaaacattttctgaactgtaaaacatgcaaaatgcctacgtgacagacttcattaacattattaaatgctatgatatagtaaaagaatttgtaaactgtcaagtgctttgtcaacattaggaatttagttattataggtatttccatatacatgttgtatttagaattccctttaattttatacttagggttgatttgtattttaactaagtcactttatatatctggtcccattatacaagtatacttttccttaggataagaaagtgatctttatatatgtttatcaacccaaatgcccatcagtgatggactggataaagaaaaggtggcacatacacaccatggaatactatgaatccataaaaaagaacgagttcatgtcctttgaagggacatggataaagctggaagccatcatcctcagcaaactaacacaggaatggaaaaacagacaccgcattttctcactcataattgggagttgagcaatgagaacacatggacaccgggaggggaacatcacacaccgaggcctgtcgcgaggtggggggcaaggggagggagagcattaggacaaatacctaatgcatgcggggcttaaaacctaaatgacgggttcataggtgcagcaaaccactatggcacatgtgtacctatgtaacaaatctgcacgttctgcacatgtttcccagaacttaaaatttaaaaaactttaaaaaaagaactgtagatactgatccaaaaaaaatgttcattaatgggggttaaatgattatttctaagtagactactcttgaacccttgaatctttaagaattttctttgctattgaagccattcaaactctattttattaaagctgtcgttattctagtagattttaaacagtaatacctgaatacattagaaatatgcaaatctgcattacatatggcatctgcagagcagaggagtttggtcatctggactcatgctaaagtctccgaaaaatccgcttgtcttaatgatggttgactcgctaatgctatgcgtatatagtcttattttaagtgattgaatgatgtggctaataacccctctgttagatgcactcagaacctcacctacctgggtcctcagctctccagtgaaatctctactttaagtttattttctaacatggtaagagccttcagtttatgttatgctcaggcccgtcactgtgaataaaatattagaaatggactttttttttttgtatttttttaatggatcccttggaactttaaaaaaattatttatttgagctttctactgttatcacagtgtctcctaagcatggcctcccgttttttgttggtaatataattcttacgttattcaaattagtaaccattatttttctcatggctagaattctggaaactattaggaaatcactgagcataattgaatggctgtttatttgaagagctatgtcaaggcagcatagagttgtattttcttgcaggggctctggagtcaaagagcctgggttcaaaccttggctccaccactttctatctgtggggcattgggcgtgttacatttgtgaaacttttgtttctccatttgtaaagtgaggtttgggggatgattaaaccagataactcatgtgaaatatttaatggaaatgtatttggtaggggatttattatttttaaatttggattgcacatgacacatgtcagggatcatgctatgcattttggatagaaagatggctaagatatcatgcctgactcttaaaaacttacctaatggtaaatgacgagttaatgggtgcagcacaccaacatggcacatgtatacgtgtgtaactaacctgcatgttgtgcacatgaaccctaaaacttaaagtataataaaaaaaaaaacttataatcaactgtagtagaaagagatctgaatggcttgccatttagctaggcacatggtatatgtgcttaattcatactagcagccactacagttgtcatgattaataatgagcttccaactgcacagaatgcttttaatccatagaaaatcaaatcagaaacaagtttttgtaaaattaatgtgaaaggagcaacaattaaaatgcaagattgacatttattttctaaattggttctattttctttcacatttacaaaatttataagaaaattctttatttctatgtgatataaagaactagaatgtactttgatgtgaattattgttgccagtgctgttcaacttttatccataatttactaagcacctacatttagacaaaggcattatccatccctttggggaggatttcagatgattcatacacagacctggtctcgaggaatttaagattttctttggggagggaaataaggactttaaccaactcaagagtacttagagaattttctgaaaataattttatcaatgaaaacttgttatattaaaagaaactgtcattctgacttccacaaatctaggcttgaaactatggataacgagatattttctattactctcactcacgtcattttcacaaagtgaaaaggtacattttaactagtgaaagaatagaggaaatggaagtagctcgaggcagtggacgatgattcaaaaagacagggccctattatttgatcaagttatgcaacgactctgggcctgtttcttcacctctggaaggaggaataatctccaagccctttcagactcttttggtaattcacctccagcacatcttctaaatgccagcattaactgtcctctgatttgtctcatgtttttctagccccatgctctcctgttcgccatttaccctcatgcaaggtacaaattacacccatcatcacaagacacttgctcaagtcccattgcccccttgaagacctgccacacctactctctcaaaaaccatcatttcctgaaagtcctatacagctcatttggtatttacagtgtactgccacaagccactaagcatcgttttgtgaatacatgacttacagacttagcttgagtaaagatacttgaaaatgaacaccatttcttggctatcttcctattttgatgtacccttcaggcctatgaattttagtataatagataaccaataattatttcttggttctttcctgcacatctgaataaccctatgcaaagtgatagaatgtttttctataaggaggtcctacactggagattgtgtatttcttaatgctgttgaaggaagagatgtgtatctaaaataaatagactctaacaaacattaatttatatttctattatctgttttgtgtattgagatatctcacaaaaataactaaacattttggcattattgatattacatatttgccatgaatatttgtaaatgaagaaaaatatatatacatcagtaattatcttggcaaactcttcaattatgcaatattgttacatagattacatatctaagtgaacactggagttttaacaatattgtgtgttcataaatgttttatttattattgccactaattcttattgccatttcaagaactatgtataagttgttctaaaaactattaaagtataggtgaccatggtcactactgcctactttggtaaaggccaaatatgtgaagactttttaatgtgttaacaaacgttgaaggttttttaacctgttaacaatcagtaggactcttgaaattatttcctaagagagtaaattttacaacttgcaaagcatgattaacctcttgtaattataaaccatctcttgtagttatgtagcattttgttaatgagcaaagaaccattgtggttcctttttacatttcttaaaataattctccgtaacctcattgatatctccagtaaatttagataagcttttttttttaaaggagggttaaaatgacattttaaactaatttttcttgttagttatacagagttgaactatctgagggttttattgacagtcataaaaaatttgttattttctgtgaaatatagagaatttaattcattatcatattattaattctgtgggccattgtcttaattctagaggcacaagctgttttcatcccactgaaatagaggaatcaaagtatgttccttgctcaaagcacaaaagtgacatactacatagtatgcttcttgagtagtcgtaaatctcatgtgttaaattacatcccaaagatttcagtatgttttatgactttaataatttatggtaatttctaatctggcctttgttgacctgtcttgctttttaaatttttagtttttcgacaaaataattaacatattttaataatcttccaaaggtgtttaaaatggcattgtatagagatagctgaaggcttttgagcttctgtgttgtaaacactttcttaataaaacatgaattgctaccagatgatccagcaatcccactactgggcatttatccaaagaaaaggaaatcagtatctttgaagagatagctttgttcccatgtttactgcagcacttttcatactagccatgatatggaatcaacctaaacgtccatcagtggatgaattgaaaagaaaatgtggtatgaaacagaaattgctgctttaatttatattaaacacactcatattcttctcagctgttaagtattgagttatagatttaaagaattctattgtgaagactaaagtgactattaaagtaagaaattattttttccattatatttaacttatttcatactttaatgttagcgccaatgagcaagactattgaatacaaaaactaattaagtagtggtgatagtacagtatataagggagaacattcttttagaaaggaacaataacagggagcaatagaaacaatgaatgagtgtaaggtcacttagtgttaaaacagctaaaatatagtacaaataagttgcgttttaatagtgattttatataattacaccttgatgttttatttgttacaagaattgtccaggaagatttctctaaagaccaaaggcactcttcccctaaataactccaaagccagtcctgtgtttctataaaaaaaaaaaaaaaaaaaaaaaaaaaaaaaaagtgaaaataacgtgatgaacatttttgaggaagtataaaaccaaaatactccactgcatagctgtttctgcaggtattgtattgatatattacattattcagctttggagtctccacatccaatgttacatcatcactctaaattaaacatgtatagataaatgaaataaatgagatagcatatgaaaatctcatagcccagcccctgcactatttaaaatagaaataccaaagaattgtattcctcatctgaaagctatttagtggtggtgtttcaaataaaaattccatctactgctgttgcttccattgtatctttttctctgcggtactgaaagagaaagagacccagaaggggccttgtctgaagtgtccctcttttaagctgttgctgctttaagcacagggtggacaaatgtaataggagtttcataaaggtggaataaaccagcggattacggtgtgggtgaatactttcagatgttaaccaggagctctgcttgcatgctgggagttgcccatgcctcttctagattgaggcacattatcatgcacaacctaactccaagaaatcttttaaaccactggaaattgaacccagaacatgtctctaagccagccttttcatcctgacaccgaatcatagcatgagccagtctgtcagggatgctgctgctctctaggcaaattttaaatgttgaaataatgaatcatgttttcttgaaaaccatgtacaccaaagaaaagttagtcattttatagatgatgaatattaacattttcttagacaatctgataaattatcagatctcacttttggctctttttaagacagttatgcctcagaaatattaataaacccccaagcccttatactgatcagtatgttcactactagctatgagaaattcttgaagttcttgtaattattgtattatttccttactttcattttattagtatgtgaataatatttttaaaaattctagtgtatgtcttgtatatattttaacaacatgacttttaattaatgtcttgataacatttcttctagtgtatgttttcagtaacatgattattaactgtaactttaaaaacctgtggattagatgggaccattttaaaatgttttaaacctggaaaatctgatggctttaggtttagttcaagctatagatcacctgtggagaatggaactgccaaaaaaaaaaatagctgtagcagccctttgagtattctaaaatagggatgttatccagagcattggtttctaaagcttccattatttattgatgttgagctttcaggatttagctacaatatttactcaacatctaagccatgcttttttatcagtcatgttttatatcttttataatcaaactgcttatcactgaaaaaaatatataagtttctatgtatctggaagaattctctggtgtttcttagatatggattttgatgtgtggaataagaattcaattcaaggataacagagatgttgtcctgaaaaaaatcgaagaaaatcagcttttctttaacattctgtcaaagctcctgactattagtttatcagcactgttttgccaaaggtgtcttctcttctcttctttgaaaaaaatcatctgctgctgctacgccgcaagtgtgttcccgctgtgcctgagaagatgtgtggcataaaaaaatgggcatggcctgagttaaaagtgctacatttaagccagagctggcttatttattagttgtctaatcataggaaaatgacagagcatgcttttctcttgcaatatccgttgctgaaaattaaacacatgagcagagctttcagagaggttgactggcctctcagacagcacctcataggatggcctgtgttgaagcatctcctttaaccagggtctgtccctcagcattgggttggctcacctagattggattgtcccagcagaaaaaaaaaacccaaaattcagaatcatatccaaaccggaatactctttcattcacattacttgtactaccttttcagaaactggatacctgagtgtgtgagggtaacttagaaacttatctcatggttagaagttttagaattagagagcgatgatcatgaaacggacttcatgatcagaagcaatggagcaaggaatgagatgtctttgaggagtatttccctgaggctgtggataacgctgacgaataatccccaccttaaaagtgggttgaccactctagtagctgtaaggtgggagggttctttcttcagagataaatctgtgctcttcacttgcccatttcccaggttttcatgtaggtagaagaaacacctgtaatctgaagacactcttccttcagctttgttagtgacagggatttaaatatgtctttcacacattttccttagatagttaaatttcacttttcctgtttgtttttctctgaaggtattctaactcccctcctaatggacttctagagctttctaattctatgcaatttctgttgatttgttctggtaaactttgaaggtaatctctgattcaacttcttggagattctatcatgtcatctctgtttattaactttatgttactcatggtttcttgatgaggactcattaaacataatgtaagtagaaaattattaactacataatatttactacgggttgttatttctgatagtagctagctgtaagattccaattgttcttcaaatctttgtctcagtgatctctgtgtagttcttgactacttcaaataacttcctagaaggatagggatttaataatctcttaataggaacacttaacacactgctggtgggaacgtaaattagttcggtcgttgaaagcagtgtggtgatttctcaaataacttacaaaagaattaccatttgacccagcaatcccattattgggcatatacccagaggaatagaaatcattctaccataaagacatatgcacgttgtgtatgttcattgcaacactactcacaatagcaaagacatggattcaacttaaatgcctatcaatgaacagactgaataaagaaaatgtggtacatatacaccatggaatactatgtggccatgaaaaagaatgagatcatgtcctttgcagcgacatggatggagccagtggccattatccttagcaaacttatatggaaacagaaaaccaaatactgcgtgttctcacttataaatggaagctaaatgatgagaacatatggacacaaagaggggaataacacacactggggcctactggagggtggaacacaagtggagggagaagatcaggaaaaataattattgggtactatgtttagtacctgcgtgagaaaataatctttacaccaaacccccgcaaaatgcagttcacctgtatagcaaacctgcacgtgtacccctgaacctaatttaaaagttataaaataaacgtatcttattttcagtacaatacaccacagagtagaagggttaaaagagattgcttctgaggaggtgagatgggggtaaggacagcacaagagcattttggggggtgatgaagctgttctgtgtcttgcctgcgatgatggctacacgactaagcccttgtcagaactcacagaactttacttcaaaaggagcggattttactacacatcaattccaataacaaatactttgtctttaagcaaagggatacctaaatatagcgtattgaatggatctccagaaaaacacatttttcagttcatgtttcagcctaggcctcatctcatccaggaaaccttgtcttgcttgcctttacatacatgtggcaatcagtagtttcttttagggctcggactgaacactcaatgaacttcaatcttagcgcttgtcgtagcagattgacatggtttatttatatgtgtcattctctgtagtaaaaggaaaggatcaaggccattcacttttgtagtgattgtgcatggcagtatttggcacatagtagattattaattatggaacttctgttttcacacacacacacacacacacacacacacacacttcagagctattttcatttaaatatttgctttagtctccaaagcccctctgcctcaacaccaacccttctatctcattattcatcagcttttctcctattacgaaactacttaggaaagcccacttatttagcttatgatggcaaaaataaatatttgtacttttttttttttttttagtcatcgcttcatagaacagcctctgtcctctgcttatgccatgtctgaatatatgctggaggtaaaaagagttcctggttgagagcttcaatttgagaaactatctgagattactttccaggttccaccgtggaacctgtctgaccttgaacaaatgacctcgaacaagtggctgaaatctcttctatttcgtcaactgtaaaatgggggaaaaccatgtctatctcatggggttcatgtgaaggttaagaaattgcttattcagtgtttagcacagtgcctgatatgcataaagctcctaggaatattagctgttattgtatttccttaaagaagcccatagctctatatgccctttcattatatgttttagtagcccaatttaacatatggataaaatatttttaagttaaatgatttgctaatggattgttgaacgagtggcagacacccatattatagacgaaggtcaagtccataacatacagtacatttccccactttcatttcccattaccaaaattcattattctcctgagaaactcattatagaattcatgtcagattcatctgtgtgttcccagcagtgccttatatccagaaataacactgagtcattgtctagatgtagcagaggtggaatcctccaaagagaagcctcagagtggccaggtttgccaagtatagggatgccttgattactggccttactctttatgctcgtgaattcctaagttttattcctcctgtagtcatagattggcttttaagctacaagctgaagagagagaaaacctcttccacctcgttggaatatgtctcttcaatccatttgagccaatttaggacatgagactgctcttagtctagaaccagtcatcaggagaattccaggtctgattgactcggactagcgggtcaatatcagggcaaaaattccaacgcacaacacgatgtatcagtaaggagaacctcaaaattatttcttaacgtccagatcatgttcctatttttatatatctattttctcacataagtcattaaaatgatgtacctgtgcgggtcctttaatgatactcaaagatcttgaattataggctaataactaacttaataagctgcagaaattaacatttctgctacgtttatgtagcattttcccacatgtacttcagaggcttgagaaaagaccctgaaataatgactgaataacagctttactcacttaatttcaaatttgttaattcttctgggaaataccgtcaacatccattttattatttttctcaattacatgtacgtttctacatcagtggataagttaaggagaagaattccctcatgataattttttcatgctcgaaaattttgaatcaattttttattttacattatactctttcctagtcattagaaagggagtggtggttaagataggcaagaatgctttataaggatactactctcgtttcaattcttaacatcaaaaaccttaacagtgtgtagactataaaataaaatatctagggatcagagcattgtgctgaactttgcaggttttttagtcaataatatatatgacgtgttcacagaattctttgtcaacaaagtacttttggagctccaggccatttaagttggtttttgtactttttctttttcttcggaagactttttttgttctatttacctggaagtgtttcttttttggtactgtgaattaaaatgagaccaatctactaggcaggaaaaaaccttaattagattgttgacacagacaaataagaatgtcaattagcatctactgtcacatgcctctccagactgcttctaggatgagtggcctcaagcagctacatcatctttatactcctaaagcatcaaggaaacttggagtgacaattcatatcatgaacacatccacagtgatgatgattgtgcttcttcccccccacccaacaacaaaggatgaatgccaattaatgtattcagttttttgcgtcaaaggctggatcacttgtgcaatgagggtaatcatcctgaccagacaggccatacaatccatattgtgtgaattaaagataatatgcgtgaaacaccttactctggatgtggttcatagcagtagcaaaaagatgaaaactatggtatgctaacattttagagatctgtactctattttaaataattttataaaagtgcatatacaataaaaagtgcacgtatcacaagtatatgcctcaaaatctaaagccagtcatgtaatcagcatccacttcaagaaagaaaacaaaacagtacccctggttcctctttgcaatcattagtctcccaagagtaatcaccgatctgatctgtgacagcatagattggttttgccctactatatttttgctgaattatacaatatatgctctttaatgtctggcttcttagtgcattgtatttgtgtatcagctattctcttgtgtgtagttattaaacaatcattttatgggctgcataatattccatagggtaaatataacagttttattgataacttagctattacaaatagtgctgttgcagacatatattctattacatgtcttttggtataagaatttacacatttcacatgggtgtatacccagaactgagattgctaaatattggggcacattgtatacattttgatttagtagataagatattgccagatatcgtaaatgcacagtttgataaatatagagatttatactttttctagagaaaagccatcaatatcagtgtatgtgtatatatatacgcgtgtgtatatatacgtatatatatacgcgtgtgtatatatacgtatatatacacacatatatatacgtatatatgtgtatatatatacgtatatatatacacatatatacatatatgtgtgtgtgtatatatatatatgaaacaactcagaagcagaaagataccccatgttctcacttataagtgaaagacaaataatgtataaacatgtacacatggacatagagtgtgtagtgataagcattggagactgaagtgtgggggtgtgcaagggaatcagtgataaattaatggctacaatgtacataatttgggtgatggatacactaaaaatccaaagttcaccactatccaacatactcacataataaaattgcacttgtaccccttacattcatacaaataaaaaattatttaaataaaaataaatatgtgtatatgtatgcatacatacatatgcatatacatatgtgtttgtgtgtgtgtatataacttacacttaaaataagcatggatgctgcaatgaatgctcaatttacaagggttgtccatccaaacttgtggcaagtatctcacctctcaagttgttttcttttttcttcatatatttcttgcttttgtctaggaaggaataatttggcttgcctttcaagagtgtacagtcagcatgataacccaaacacttaagacacgtgctaacccatgtggatcccttgagagaaggaaaacagtggtccttttactgggcagatagagcccggggccaggtttcgtggcttgaagatttcagcttctctgcgcctctcagctcagtgcctctggaagcaatttacaacttgtgaggccatactcaaaggccctgttattaattccccgccttccgagaccccatttcagaggatctcaattgctctcagagtgaatttactgtttcctgaattccgtaatcccaatagcaggtctgttgtcctcattagatagcttaagttagagtcggcagtgtaattggcaactgagctactaagtatccaatgcttatgtggaaaatatgttccctattgcaaacaactgatattcatattcaatttggcaccatcatctatctataaagcagatactacttgtgtttattaagttttatcccaaataattattttagtaataatgcttgaaaataggccttggtcatttgcatgtctgtatatggcatatcctgagtctttgtatgtattagaaagatcactcgttttgacttgatggtttaataaaagatgtccctcactttgggcagagacatttgaaaaaggcactccaaccagggacctaagaggtgaatgagatgcagctctgaatcaggtcacacggcctcaggaaggaaacatcttggttttcacatccctcacttctcgatgtcatgtgcaatacacaaatgacccctcaacacacacacaggcacatacacaaacacacactcactcactcactgtattgtctctttccttgactaagtccttcttactaactcaagctctaaagcttttttacttacctaaggtgagtgtgtgaggatttgaggtttcaatattaaaattcagaaacatttaaagttcattttaaatattagtaaaaaaaaatcttgacaaaatacaattatagacaaaaagaaaattcagaatatttggaatttaaggttgaggttacagccctatttatgaaatattagaagaaaaatgctggagagaataaagcaggtttatgagtctgatagaaagcataaccagatgattatgcatatatttgcatatgcaaagctttctaggcaatctgaacatttaaacctacaaatgtggctgcgatgaacagccacagaagagcaggctagaacagaagaggaggctagaacagaagagcaggcagaagttgtaaatgaaatgttaattttcaatggttgatctcccaagtactggaacagatttgtgctgttttcaaggttttggttcaaagaatccagtagtgtattgaattgttttgtggcacttccctgttattttgctttgtaagctacctcaatccatgaagtggctatgagccccttatacaacactgttgatttttttttccttatctacgcaaaagatttttgattcagggccaggcatggtggctcacgcctgtaatcccagcactttgggaggccgaggcaggcggatcatgaggtcaggagatagagaccatcctggctaacacggtgaaaacccacctctactacaaatacaaaaaatcagccgggcgtagtggcatgtgccggtagtcccagctactcgggaggctgaggcaggagaatcacttgaacccggtagccgagatcctgccactccactccagcctgggcgacagagccagactccatctcaaaaaaagaaaaaaaaaaaagattttttattcaggtggctatcagactcattaaatagaagccttaggttaagttcacgggttgctagttggaagcctccatggactatgttcataaaataatagaaaggagttatgcaggacttcttgaaatgttatttaaaaagtcagaataggctttctattacttgtctgaggtcaaatacatgtagtgctttctgaccatttcatccagggtgttagctaggacaataagaggtgcttaaaaattattagattgagtaaatgagaaagcccttagaaacataggaacagaatgacccttgctttggatctaatattgactcccacgcctaaatccctttggagaactcctttattttctcttccatcaagagcaggtataaattaaaaacaccattaaaggggccatctagctcagctgaagctttcatcacacatgtaggggaggtatggttgggagggatctttttatcctttaggtcttcaatttacataggacttttgaataatcaaatagccccaaagagctgatcttaggactagttgtaattgagactatttctccatggggtagaaaaatctagttgtaggaaaactgagaagtagatgtatgttaacctcaaaggctgttttttacaaaggatgttaaagcatcatctttgctcagaaagggagcaataaaacaaatgagtggaaataacaaaaggaaataatggccaggtgcagtgcctcacactagtaatcccaacactggggggctgtggtgtaaggatcgcttgaggctagcagttcaagaccagcctgagtaaaataggcctcatctctacaaaatagatagatagatagatagatagatagatagatagatagatagatagccgggcgaggtagtgtgcccctgtagccccagctactcaggaggctgagatgggagaatcgtttgagcccatgaggtcaagtctatggtgagctgtgctccctcctgccactgcactccagcctgggtgacagagtgagatcctgtctcgaaaacaaaaggcatactttttagatgtaatggaatagagtacttccaaacctggctgcctgctggagttgtattggaagaggttgcacgacttcagtggagatggcctagatgcctgctcagcagtcatctagttaaagcaactaagaacatgtaatatgaaactgcaaaaagagatcgtgtacgtaaaatcactctgggctcctcagatagagtaataaacacaactcctgacagccaaataaaaagagaaataatacagcccttgacttccttggttgctttgacatactaagtaggtgttacaggttgggttctctgggaaacagactctaaaacatttttatttttactttatttgttgttattattattattattattattttagacagaattttgctctcgttgtccatgttggagtgtaatggcacaatctcgtctcactgtaatttccgccttatgggttcaagtgattcttctgcctcaaactcccaagtatctgggattacaggcaagtactaccacgcctggctaattttgtatttttagtagagacggggtttcatcatgttggtcaggctggtctcaaacacccgacctcaggtgatccacccacttctgcctcccaaagtgctgggattacaggcgtgagccactacgcccggccagactctaaaataaagtttaatatgcagaatacttatcagggaatgcccactggaccaatacatattcaagagagggcttagaagcaggattggacagaaagagaagttgagctgtaatgcaggcccaataacagccttagtgttaagcaggctgagagattcagcagttaatgagacagtcaacccaaacagttttataggcatcaaaagtatgatcagcatggtgtcagtttcctgtgtcacttgtcccacagtatgataccaaaattaaagagaccagatgacatgcaacacaagcagtgtgcactctgttgttgagaagccaatttcgtcatgcaattaagcagttttatactctgcagctgtactttaaggggagctgagatggaacatcatatgtctcaccataaccagaaaggcagatgagaaatgttctatcgccacctcccacaaggtaagggacttccctaaagatacagaggtgggtggaatattgccttggtagacttcctctcaagactgcctatcttcccatgttggaaggatcacagagcatttgtcaagacgtgggtcaatctgcagttgaactttgtgtatgtggcctatgtggatacttataatatcattgggcacctccatagagctgtttcccaattgaccaaacatatgggaagcttcagagcttcgaatgacccttcagagtagtcctgagaacagtgagccttactactcctgcattaatcagtcattggatgatagccttctcagaaataagtcatgaccttgtgcaagggggctcttcatggctgggaccacccctaaaactgagagctgaaggctgtctgccaccagcccttccacctgctgggacaagttctttattgaagggaaatctgagtagttcatcagcgtccatcacagtagtcaagccgttcattcttccttcttatgacaacattgtgcttattgttatgtaatccctttccagaacattttaggttaagttttaaaaataatgcatataaatagacaattcaaatactggggaaaaaaagcttgcacttatattgttatagaaatgtgcacacttaaagagctgatttcttctgggtatttacataactttatttaaaaatccatccatttttaattagctgtttttaatatgcagttagctaagatattataagccatatattaggctaatggacatttaacagcttagttaagttcttttaatggaaatgctgacaaacctttgtctgtaattatagcaacactgtgattacagaaggaggtgcctctccttgttgtttgcagccctaaaattccatgtggctataagtaacaaagtccattattagataaacacaagtcatacttggcattacttgcattactcgtctccttgctttatttgaatcattttttaaagttgtaaaatgtttttcaaaactcagaatagtggccagttaataatatgattcctcttatattatgagattttaaaaaatagttcaccagtttctggtggcctctatacccattggcaagtcctagccattgtgaattaagtaaacaattctttatggaaattttttaatccttaaaccctataagtttttattcatcatgtcaggtcacttgtcaaagggtttaacattcagaattcaacaaaagtttatcaaacacctattacaggacgtgcaattttgggcgcactgggatttcagcaattaacaatcaagatatgatttgtatcgacatggatattacattctctcacaggagacagaaaacaaaataactagaaaatatacataaagagactttaaaatggggtaaaattacagattgtgacaggatgaccactttggttcagaatatctaggacatttttttctttttttttcccctccctccctctttcttttttttctttttctttttctttcttttctttctttttctttctgcctttcggagtcttgctctgttgcccaggctggagcgcagtggtgcaatctcagctcactgcaacctctgcctcccatgttcaagcttttcgtgtgcctccgcctcccaaataactgggactagaggcatgcaccaccaggcccagctgatttttgtatttttagtagagatggggtttgaccatgttgcccaggctggtctcaaacttctgacctcaagcgatccacccgcctcagcctcccaaagtgctgggatttacaggcgtgacccaccaggcccaagcaaggacatttttttctgagccatgttatttaaacagagatctgaatgacaagaaggggccagctctgtgatgtaggggaagaaaaatatgttccttctacccttctaggctgcccagctggagtcctacaaagttagagtgacaaaagacagattaacaagaggaaaagcctagaagtttattaaaatattcagtgcacatacacctggtagaaactcagtgatgagtaactcaaaggggtggttagaatgttgggtttatatagcatctgaacaaagaacagtaaacttgtagagaaatgacaaaacaaagaaaaaaggggtttaggtatttagggttgccaaactgtaggaaggtaaatatatgggagaaacatggagtatagtttgtttatgccaagtctatcttgagatcaacttttcgtattcttcatggccataacaatttcccaggagagagggcttatagcagttatcatttctcagaagtttctgcttttatttagacaagggaagcactgggaaggcttctttttgcttatattgattcttacttgcctctaactaaaagtaatctttatgtcaaagtgccatattttggagtggtatatattgatctcctataataacaatcaaaaggaacagtattctaggcaggagtaccactaatgcatagtgtttggtgtaaagacaagttaacatattcatggggcaacaacaacaataagccaatatggctaagacattgaggatgagtgagttggagaagtaggcaatggccagctcatataaagacttgttcgtttttataaattgtttagattttattgtaattatggtggcaagtgattggagagtattagcttcactttgactggcttatcgaaaacggaatgtagggggtgaaagtggaataaaaagaccagtcattaattgagtagtccgtgtgagagatgatagtggcttggacaaggacgattgtactggagagattgaagcgactgatttcagatttgtagtcaacaaggcttaattggtaggagaaaaaaataaatcagtgttaactctttaatgtttaacttgaataattatgatgagggtattaccatttattgagatgtagaatattataaagtaagagcagatttgttcaaaaagtatcaagaatctttatttggacatgctagtttggggatgcttattagagaccctaggaaactgaatataaatgtggattttagagaagagcttagggctggcagatgcacattaaggatctgtctagagccatggcgctagagacctccaggagaacataaatagtctcaagatcaagccctgagacactcagatgtttagaagtggaacagaagagggacatccaatatagaataccaagaattaggaggggaatcaagagagtgtggcaatatgaaagatacaaaaagagtgttgaagggagggagtaattaataaccagcatgttatgaggggctcagtataatgaaaagataagtgactattggatttggcaacatataattttttggtgatctggacaagagcaatttgaacagaatgatggatatggaaggtccagaggagtaggctgagtaaataatataaggtgggaaaatagatacaaagattatagacaactttttcaagaagttttactgtgaaggggcacagcaagctgagacagtgaggataaataatagactcaaggatggtaactttagaataagaaatttcaatctgatgggatttaagtgttagcaaggaagctttaagaagttattttccccattagaatgatctgaaaaatgttttagaacattcctcttatattctattttatcacatttatataactttcagagaattgaaagaggtattaagttattatgaaattttctgagattaataagataacaattataggatgttttcttttagttgaaatacacctactcagcctaatttttataacttcttactgaagtataatatacttcagtagaaaagcatgcctaatataaaggtgcagctagatgaatttgcacaaactgaacacatccctttaaccagcacttagattaaaaacagaaccttgatgatacctcagaggcccccttctgccccttttcagtctctccgtgctacccccatggataagcattatcgtgatttctaataccatagattaattttgccagtttttgaattttatgcaaatggatctatttcacctaattgtaaatatataacattgtcatagcaaggcactcattgccttacactgaaaattacattgactctttgccacaagcttagacttgctttctcattttattatcatcaagcctatagctttcacactataccttgttcctgctcttccctactctatttcttggtagatattctatatcagtcttagagtgcagtttgcagaacccctccatcagaatctcctagggagcttgttaataatgcagattcctaggcccctcccatggtttatgaatctgagagtgaggcagacaagactataccctctcatgcctctataatgtaataatgtcttcctagaatgttctttgctgcatctcttattaaagaaatcttatgggccgggcagggtggctcacgcctgtaatcccagcactttgggagcctgaggcgggcggatcacatggtcaagagatcgagaccatcctggctaacacggtgaaaccccatctctactaaaaatataaaaaattagccgggcgtgctggcaggcgcctgtagtcccagctactcgggaggctgaggcaggaaaatggtgtgaacccgggaggtggagcttgcagtgagctgagatcacgacactccactccagcctgggtgacagagcgagactctgtctcaaaaaaaaaaaaaagaaagaaagaaaaaaagaagtcttatgtttcctttatggccagagcacaacattgtcatgaagtcatctaaaatttcccactagaggtaacatctccttcccctgtctagctcttttaaagcattacctccatttgccttgtatcatagctgcttgtacacctgtctgtctttccgctgaggttataatcctctggagggtcatgactttgcattcctttgtgtctcccattagcagccagcacagtgccttgcatactgttagttctaaataacttctctctctctctctctctctttttttttttttttttttttttttttttttttttgagacagagtctcgttctgtcacccaggctggagtgcagtgcaatggcatggtcacagctcactgcaacctccccatcgtgggctcaaatgattctcctgcctctgtcttccagtagctgggattataagtgtctgccaccacgcctggctaatttttgtatctttagtggagacggggtttcaccatgttgcccaggctggtctcgaactcctggtctcaagcagtctgccctactcggcctcccaaagtgctgagattacaggcgtcagctgctgcgcgcatccctaaataaacttttttttttttggcatgaaatctgtaacactggaaagatgttattgccttagaataattaagagattaaatgtagaatctcaaaaacattcatttttttccatgaaaactttaccaggcctcaagggataggaaaattatgggtacagaattgagaatctgtaggaacttgcaagataaacaacggtttcacaagaaagaccttgttggagagttaaattttcagacagttgtaataacttcacattaaagttttgtcaaaaaataagtatctgcatgttttgtttgccttccaatgccctcattttatttgattttttcccataagtaactatagtgaaagcacgaaaatgtgtttctgtgtttgtgtgcctgtatgttaattgtgactgtttctattgcattgttattgcagaacctaggcacgcactctgtaggcttgggtgctttctccaactgaaaaaaatcctacatatggataaattatttttacagccagtgtttaattttacaagtggtccccctccttctgtttttaggatggcagagagaatacatatttacttaccattatcacttactcatgctttgagcttgaaggaaatgagacagaaaaatgaagtaacattaacttctctctggaactatgtttctcatattagagctttatctgaggagttcacttcctctctcttcaatgctttgttcctctccagtcgattcaaatgtcctcttaaagcagaagttccgaacctctttctgtgacttcaggagagcatgagaatgtaaatataagttttaggactaaattttcaaagactttttccactcagctctcttttcctcttcggtttgttgttgtcgttgttgttgttgtcgttgttgttgttgctgctgctgctgctgtttttccccttccacttccgtaactgagctcttagggtccatctggaatctgattgcaattaaaaaaaaaaaagtttatttttacctccttgtacgtgctttctcctaaagcaggagtcagaagccttttttctttgaagggctagttagtaaatattttaggcttgtcgtctttgtcgcaattactcaactacgctgttgtagtatgaaagcagacaatacatacctgaatgagcatggttttgttcctagcaaactttacgcacagagaaatttggatatcgtataatttttatgtgttgcaaagttgtattattcttttgatttctccccaaccatttaatatgtaaatcccattcttagcttgtgtgccatacgcacacaggcagcaaatgcgagttgtcacacaggctatagtttctgactttatgtcttaaagtaaacagtaataatcattctctttttccaaacagtccactaatctccctttgtattcagcccttgcatagtaaacgccgtttcttcatcatcctgatttttattctgagaaaatactgtatattgttcccatgcactagggttcggggaaatttaaaaggatgtaggatctccttttcattggtcctaaaattgcactggggaggcaggtcatgtttatgaacagataaatagtatcataatataatcatgcatttctatggctagcatttagaactatagcttttgatgtcatgtggtttttatatggttgattatttttttcttatttataaaatgaaaaagtttgagaatttttcatctccttaatgtattcccttatttgagggaaaagtatttacctactacataggaatttatcttaaaattttctttgtctatctatttttatggaatataatcgagcaactattttactaattaatactttaatatcattatgaaaatgttctcatatttttaaccttataagatcagataattgctatgccaatctatggttgaaatgggttcttatacttaacgctatgctctttcttctgagatgtaaaaatatgtttaaatcagaatttatataggtgtcaattcaaaatgacagtagttcattattttgattagtataaatgttcacaactaattctattctcttatctattaagtcaccaaataaagtatatttgttttaaatatttaacagtttaaattattctttgaaaacttatgagtctaaagtaagaacaattaacccattcattttgcaagtgggatagttgaattttacttgcaatccagggatttttgacagtttgaaatatacatacataccatgtatgtttaggaaaacatttaaaaagagggggttgtaaaataataatagttcttccatgattttttagccataatgtttataatataaaatatgtatactcttgttattgaatgtagtatgtttctaatttaccagaaggcaagagaataatcctggagaatttctcaaggcatcttcgaactctttgatttattgctcacatatagtaatttgccaaatgacgccctagtgaactgaaagaattaatgccccgtcctaagtcactttcaccgagggactgaaaacctgcagcattttgccaattagaggaggaaacaatctaccttgcagagtcaggagtactggataaaggagctaagagtgttgctttttttccccttcttactttaaaaatcccaattcatcccatgtctttcttaaaggctaagtgaagtagtaagtacgtttttgcaacatacgaatttagcagactggccttgtgtttatttttggccggaaccattacacttatttccaaccctctcctttatttgttggttgataatgggctaattttgaatctttactgtcaaaagaacattaagagaagcagccctgcctgcatcgcaggctatgtctgtcctttgccgagtattaaacactaaaaaaaaattaagaaaatactaacaaaatgacaaagcattaagaaaataaaactagatgttaaaggaaatgagaaaataggaaaggatgctgtacctggagtgattttttttccccaggctacctaagatgatcaaaaaagagctaatttctcttaggtttctattaaggaattactagaatatcgggcacaccaggaaactttatcagtggacctgtcctgaaccaaattttcttaatgtatatatgataatttgttaccacatcccagattattttacaggaattaaaatatatttgaaacactgacagggaaaattgggtaagacattgatagatactacaatctgtacttgaaactgcactcaaggaattcgttagtcaagaaagaacacaatgactgtgggcccctctgggttttggaacctcttttgtaaagcatttttttttttcccaaatagaagatattatttttgaaaaggttaaataaaaaatctttgttcactatatagtttcctcctaaggagtaaattaatttatataaaatattgcaatataaataacaattttaaaatctcaaaagagcagtgttttaaaaataatgtagaaacattaagaaatgacttcaaatgataagaatgtcattggagagcaaagggtttttaatattacatatcgtggcacgtatatcagcacccaaccgctcaagatacagagttctttacaaaaatcaaacagaaggaaatgtgccaccttgttcataaactatatttaataataagccaggcagataaagtcactttcacaaataatgagcaagcccatggtaatataattcatttacaataagatttatctcatggaattcttagactgtgctttgaaatttaaataattctgataaatgccaacagaatagagaaatcaattccagagcaattactaacacgttgcattacctttctaacattaatatttctcttcatacatatcattgaagagaaaatgaggatggaaaataaaaagatcaggtaatatatttgctttctcatctagggttgttatgatcttcaagatgaagttttattttttactcctagcaaatgatattcttttttattttagtttttattattttatttttctgtaaattattggggtacaggtggtatttggttacatgagtaagttcttttttttgatatttctgagattttttttttattctactttaagttttagggtacatgtgcacaacgtgcaggtttgttacgtatgtatacatgtgccatgttggtgtgctgcacccattaactcgtcatttagcattaggtatatctcctaatgctatccctcccccctccccccaccccacaacaggccccggtgtgtgatgttccccttcctgtgtccatgtgttctcattgttcaattcccacctatgagcgagaacatgcggtgtttggttttttgtccttgcgatagtttgctgagaaaaccacgaggtaccatctcacgccagttagaatggcgatcattaaaaatcaggaaacaacaggtgctggtgaggatgtggagaaacaggaacacttttacactgttggtgggactgtaaactagttcaaccattgtggaagtcagtgtggcgattcctcaggcatctagaactagaattaccatttgacccagccatcccattactgggtatatacccaaaggattataaatcatgctgctgtaaagacacatgcacatgtatgtttattgcggcactattcacaatagcaaagacttggaaccaacccaaatgtccgacaatgatagactggattaagaaaatgtggcacatatacaccatggaatactgtgcagccataaaaaaggatgagttcacgtcctttgtagggacatggatgaagctggaaaccatcattctcagcaaactattgcaatgagtaagttctttagtggtaatttgtgagatcctggtgcacccatcacacgagtagtatacactgcaccatatatgttatcttttgtccctcggcaccccttttctaccccccaagtctccaaagcccattgtatcattcttatgcctttgcatcctcatagcttagctcccacgtatcagtgagaacatatgctgtttggttttccattcctgagttacttcacttacaatgatagtctccaatcgcatccaggtcattgcaaatgctgttaattcattcctttttatggctgagtagtattcatatatatatatatagacacacgtacatacatatgtatatataccgcagtttctttatctacttgtcgattgatgggcatttgggttgatacttgcacacacatgtttatagcagcataattcacaattgcaagtgatattctcaggaagcatgatgtaagtgacagagacttactttgtagactgcactcattcacttgttctctgaatgtgctctaggcagcctgagtttctactatgtcagtgttacatagatgagaaaccccatgggtggtttccacagaggctgcaatactatttttgataccaaaaatctgtttggttttgtgagccccagatgcccatatggaaaactgaagtgttgatacctctttgtagccctctgatgaactgcatggttcaccttcctcagcagtttgagcggggtggggagagcgcctgcttcctagccatccgattggcctgaatcatcaaaaatgctatcatgaaacaggttctgtttatctgctccagattacacccatcatgttctagagtgctggtttcatgcttgaatctagatcaagcctgctttcctcccctgcctgtactccctgtggctacctacagtcctgctgctgacagataatctaaaccaatagcacctaattagcctatttgctcatgtgttttttccatcgtggtataatgtcctccttgtcaatttagggtgaaaatgtagcaacacgttgctgatggtttaatttctggaatgcaggtaatgaatgtgtttttgcttatccaagtcttcccatcagatgtcaaatatagaagaacagtgttcagaggtcctaaatttaaattggagtgagaaattcacagcgcccctgaactcaggcaaaatgcactctgacaagtcaaccagatattcacagatggtctggaggatttgaagcctaatttggtgaaataaaattaaatgagtgaaattgtatgcagtcattaatctatcaccatacttaaaatgcttcattgaaatttcttttactgcttcaaatgaaaaaagatcaaactatgttatagaaaagcattcaaaacccttacataacatagataaaacttggttggagacttacagaactttctctgctgcttcgagaaagttacagtgcccacaaatctattgctattagaatattttattgtattcaacactcaattctaccataattatgtatatgagaaaaatatttttacctataaaataattattattaccttttaaaaatctgacattcttccttttttctaaagaaacatatttagatttagcttttattttatttttgtgttgatacatagagattgtacatatttctaagattctagtgatattttgatacaagcgtataatgtgtaatgatcaaatcagggtaattgggatatccaccatctgaaacacttatcatttcttcttttcaatgccatcataccaaaaggaagtaaatagaatttcaaatataaggacagccatgattttacatacatgcctacgattccaccacaaaccataattacgtcccccaaacttttaacatttcagatactttgtcccaggtatttcatgataaggattgggctatgactctgttacagaagggccaaatgactaaaatgtctctgaacaatattgattgcaaatattctacccagttgtcaggtcaatatgttccaattcggaatttataacattgtatctctactcccaaaccatccaatctcacctacctcacttccatattatggtgggtgatctcagattatatttaagctcatggttacttgtcaagtagatatggagtttagcctaacttttgaaatttatgctgagattacccttctcattatagaattaagtaggcagtttccaagtttagatttagcaggcagtttttttcaaatcacttaaaagttatatttttttagggcattgaacaggtttgaaatcctaccaagatgtcatgtacacatagaccaatagaacagaatagagaacacataaataaaactgcacagctacagccaactgttcgtcgacaaagtcaacaaaaaaataagcattgggaaatggattaaagatttaaatgtaagacttcaagctataagaatcctagaataaaatctgggaaataccattctggacattggcttgggaaagaatttttgactaagtccttaaaagcaattgcaaaaaaaaaaaaaaaaaaaaaatgacaagcaaggacttactaaaataaagagcttctgcatggcaaaataaatgatcaacagagtaaacagacaaacaccaaatgggagaaaacttttgcaagttatgcatctgacggtggtgtaatatccagaatctatgaggaacctaaacaattgaacaaacaaaaatcataaaacatcatttaaaaaatgggcaaaagacatgaacagacatttctcaaaagaagatatacacgcagccaataaacatgaaaaatgcgtcacatcactcatcatcagagaaatgcaaatcaaaaccgcaaggagataccatctcacacccgtcagactggctttgttaaaaagtcaaaagacacccaatgctggcaaggccgcagagacaaggggatgcttatacactgttgttgggaatgttaattagttcagccactgtagaaagcagtttggacatttctcaaagaacttaaaatagaactatcatttgacccatcaatcccattactgagtagatatccaaaagaaaacaaatggttctaccaaaaagacacatgcactcacatgtttgtcacagcactatgcacaatagcaaagtaatgggatcaacataggtgtccgtcaacgttggattggataaagtaaatgttgtacacatacaccataaaatactatacagccacgaaaagaagaaaatcatatcctttgcagcaacatagatgcagctagaggccattatcctaagcaaattaacataagaacagaaaaccaaatactatatgtactcagttatgagttggagctaaatgttaggtacttatagaattgaagatggcaacagtagaaactagggactaatagaaggggaaaggaaagggggagacaagggttgaaaagctgcctattgtgtactatgcttactacctggttaatgggatcatttgtatcccaaacctcagcatcacgccatatatccaggtaacaaacctgaacatgtaccctctggatcttaaaagttgaaaaaaaaagatgtcatataaatattcgtggtcactaaaagtatctaatgtattatacataaaaataaaaattgggtgaattggaagtgtattctttgtatcaagtcatgtcggagatcctattctgctttgatcacagtgtgaattcttttgcatttttgttaccagtcacttctttatttattgaactaataattacatattctgataatctgtcagaaagataaaaacattctttgtccatgtgtctgaaaatttttaacctatttttctaatgttttaagtgagaagagcatgttaatactgaaattgtaagcagtagactgaaaaatcatcccaatccatgggttatatattgaattgcttttaactgtattactaaatattaagcttaatttattttatttctacatatccccatttccactataggtgatttgtatgaatttaggaacttccttctctcatccatttttatattaaaactcagactttctaaaacaatatttctatccatccatcgttggtaactatgtactgacatgttttgtgcatccgaaaaatgttagcattagtttgtgcgcacagaagtaattccagtcaccatatgatgagctgatttatttatttcgtaagtgtgttcattattattatctcttcagcacccaaatatataggggacttaatgatacctacaagtaaaaacggaagacaaaaacgccctgctctctacagaggttaaaatgtttttgcaacagggctctagatctcagctgtgaaagtagggacgagatgaggctaggcatgcagtgtcagtataatacaatataatcaacatgtcagcatctaatgcaggtgttgcaaaacaaaatgtacacatgggtagtcaggtaacagaaaagcatgaagtagtaagggctatctatgcaagaggttccaagctgactatatactgaaatatttaaacactatgtggggcaaataaaatggacattagaacagttcgatggtcagttggggacttctgctctttcttccagtctctgaacatatcttaaagccacaatcatctatttttatttattgttatacatttatttataagccagcacccctgtgatttaagttctgttgaaatgctgagttggaaaagatcgatggatgggggaaatttagtgcagaggttttgccccaggttcaaaatcctttataaaatattaatacatggaacaaatattgaacaattaaaccactgataagttaatcaatctgattcaaagtacacctgtgaagagggacatggcaagaaaaatattacagtaagaactagaaacattccttcatggctgcttgatatggatatgtcatgtttaagaaaattcttctttagactgttgagattttttttcctgacaaagaagattcactgtcgaggaaagaaagaggtactgtgaaatttgttattgaaaacatgcacatacttttgtcagaatgagttaaagagtgaacaaaatgtgcctattacttacgtgttgtgctgttttaattcaagattaaaatatttaacgtccacagacaagaccacttttatatgaatattatttttctgctttattgctcaattttattaccatttcaaaacacccgtgttgctttctatggccaaagatgtttagcacttttcatggttatacttctgtacagtccaaaatacaacacttactttacacatacacaaacatccaatgtattttgttttctgtcaagtaaagacaatgtctgtgttattaagttaaatgtcactttcaaatacaggatatgttgatattagaatgttcaactttatttcctcatttaagcaaattacagtgtgaagaatgtaactgcagcaatttataaaaatcatatcacattcaattatgagagcaaacttgttttgtagacttgaactagtttcaattaatcttggagttatcatttcaaaaattctaaacagagagaaatacggagtgtaataatggtaggtctttgggtaagctgcttccaggaaaagaaagcaattatatatgttcacatagcactgacaaggagaaacaaaactttggacggcaaagaacttgcattagtctttttgacatgttcctgtggtgtgatttattacgtagacaatcagctcaacttctcaagtttgatatccttggaatcatttgaaatttaaattttaatgaaaattcattaattccaaggccaaaagaagtgattctaattgcttttgagaatcagactatgaaagaattctttggcaaacttgcactgtcttttctcttttatcattggttgcttcgtaggtacttaattgaaggtcctctgattatcagcacgggctgacatcagttcactccatgcattttaaacagtaggccagatgtttaaaggatcagctgaagcatcgatagcatgctagggtgaataataaaattttcattatctacaagaagcaaataaaaagcataagcattttcccccattatcctgaaggagaagatgaatgcctaagcaacattttaagaatgggttgagtgtggcctgtgggaaaatttgggtagaaaacttgtagttagctaatgtatatactgtttgcctctttagctcaccatatacccacacacatgggcatgcatgcatacagacagacacatacaatacacacaacaaacaggaaattcagatatactgaagaaatgtatttaagggattactaagtttttgtaaataaaatcctttaagatgctgagaaacaatggaagagaagtaggacatgatggctcatactttcgtaatttacttgtttaacgtttgccaaggtttaaattaatgtagatgtttttgtggctaggattaatgatctaacagtttggaataattaggcacttttatcacctagaaagcccagaaacccagcatgcaaaaattctggtatgtctgcattttacacttagatataacagagaaatgacaagtagtcaagtggatagagaaacgaatgattcttcacacatgcacacacacatagaaattgtctttttaatagtattttaatgtaacacatttatgcataatttctccatagtgtttatcttatagtgaatatgtgatgaatagtctctaacattagtggttttatagattaaacataattaaggctttatatattaaagagtcaattggtgacattctaatataaacatgtttatctcatatacattgaaatattagataattcattcgttgagaataaatcgaatgagtcaaaacttttaacctccactttgagctttgtaatagtatccactgaaaatattcatgaaaatttttaagtcatttctatttatatattcagtccaaacatctcacaagtttaaaatgtaaactcaagaatataatttctgtattctacaattggaagcatccatcatatcagatgaacttatatagtttgtgaaattttgcaaactttctgtttagtaaatcttaatgtcaaacattttaacttccaggttgtctttcttttcagttttaatatccgcgatctttgtatactcgttgaatggattctcaataagtaacccacaaatatatatacatactatgtacctacaaaaaataataaaaagtaaagaaatcgacacttatccatacctgtcccatagtaataaactattcataagtatatttgaaagatatgagaatcataaaagttcgtgtttgcacccttttgtgcgtggaatcctaggtttgcattttgtggatctagactttttggagtgtggaaataaatgaaacaaataatcgagacccagtcttatattcaggttatcattttactacataaagcataaataacatttgcagtttgtttctatggctagctctaaagtcttagcaacgagaacattatagaaagacttcaactgtagcttccagcagaacttctgaggttccgtttatggactaagcagcagttgagggggacaaaactcataggcaattgatcactccaaaggatagattgtcttttctaacctaatcaaaagatttatagtgaaggcatattcagattttgttgaaggatatggatatataatcatgtgtgtgtgtgtgtgtgtgtgtgtgttagacatacttaaaacattatttgagtagaaaattctgcacaaatggaaaagtataacatgtgttatatccacacatgttgagcatttacctggctgaaacatcaaaagctgaattgacttaattgaatgttgaatacttaatagttactttgtagtgactcactattaaaacattatctcaagctttgtcagaattaatttttttaaaaaactcagattagtgtcaggtttactgaaacagcagatctgaaattactgtgtttttttttcctttcaataatcagtttctaatccaaaattgaatatcagttccaactctacattcagtttctgttttacttgtttggactggcttttggttctgttttccacatagatcctctctgtgtaagacaaagccatttgtgcagattaaattttactgagcgtgttaacctatttaaaacattcatccaaaaagactagtatgaattcttcatatggcaagctgcttgttttaaaacttccatttattctaaaatcctttttacttatactttttaagaaacgtattcccgatatacaaaagtaacacatgctcattaaaacaaattaaaaatagtattgtataaagagctgatacatttctgccttgccccatttaactttcttaagtgttcatgtgaatcatccattcacatcaagacatttatctgtattcatatgaacgtgttttaatatatataacatatatagaattttatataaactttccttttaaaatagaaatgaaattatatgatatatttattctgtgtctagctcttgtcacgtaattattcaagaacatatttctaggttaatatctgtattcttaggtagcattcactaactcctcatctacttgttttcttccattctaattgtgtttaacatttcttcatacaattggttgtcatttggtcttctttcatggagggtgcataatgttcattctcaccaattctttacactttacataactgcttgatacgaagccagaccttataaatatcaacaaagcaggaacactgtaatcagctatcagtttcagttgagctgaatgaccctgaatatgtgtacacatattttccaggagattttaaaactgacacctcagatttctaagacctggagaaatcagcatgagaaacattgatctatattattccgtgaaatgatttcactaaatagtgaagcatctcccacatgtggactctgtaatttattagaataaagagttcatgtgcttctgaagaacttgaactactcttctggcctccgtacattggtttcttagctataggaaggctgagcatgtttttcctatgcgtttcctttctagctcatcattttagtgacaaaacaatctttcgtggtgttgctctagctatagaattgtttcagattcatttgaccaaaggtggcaaatacaacagtcccaacaaaaacaaaagacctattacagaatgatggaaatgaccccagggaacaatggcacctccacatttcttaattccaaggttataagcagtggtgtggacaattctcaattccaatgctgaatcgccttctaatttcaaatacctgtgctaaaaattatttacgtctactgaaataatgaactggaccccaccaggaatggccgatatgcttgtagtcagagcacaactgtagaaagaaaataacattttaatttatagaggtatgatgatagctgtttcatactgttttcagaacgatgaatggcctgctcagtagtttcttgtcatcgtactgagacactttaatttcttaccagctgagatgaggaatacgagcccagtgtgcaggtgaaattggttaacaggagccattaaaatttggaagagtcagaatagcatcaatcaaaatgctttcagtgtaggaagtaaacatgtactagcctgacccacctgtcttttcttttaggtatgttggtaatattacaatcattttgaggtatccataaacaactgcttagatctgaagaattgtatatctttctttactctgccctggcctggggttatggttctcattgagctctaacctttcagaaaaaaaatgtagagaagtggttcaagaagaatgctttatcttgcttcataaaaatgatagtgatagttttattgaaggcttactatgtgccaggccaaagtgcgttttattatcgttcccattttccaggcaaagaagctggagcacagagaggctaagtgagttgtccaggatggctcagctaacatgctgcagttgggatttgcacccagaccaacttcttttcaaccactgtcccatcctgtgtcttctctactcaaaaagtgtttcagctccaaacctgaaactttaaagaaaaggaaatccttagtggaaagactaggttttagtcacaaattatctccttccttacattatttgtctctttttcaaatactccaagctttgattaaaactgtctatcactaggaacattgtagaattgctaaggtggaattgttaaaagaactcaattccaattaactttgccattgattactgtgtgttctggaggggtgttctttctttcaggttaatgatgctttattgtatatctcaaagattaaaaataacaatgaaggaagtagcaaaccggaacttctctcacaatgcatctttcaatctcgtgctttaaatgaagataaaatcatggctgtggtaaggttgcaggaaggatgatatagattaagtttcttgcaaactgccctctgaattttcaatagctgtagaaggtattggttttccaaaaaattgacaaattgaggattcattcagcagtttttttctaggtctcttaccagaaagtgatcactaaaaagtgtagggaaaccactcaaagttggatagatcattattttcacttaagcattttaatttcttgaaggagctttataatgcaacaaagaatttacagtcctgtgtcaccgcttaaattttctagggtcatcagtaaactcagtggaaataaattagttcatgaatataattgacccttaaattctgtcactgtgcaagtaatcggtgggtctgctggatatggctttcgagcagacaggtcaacttcttcaaacagagaagaagcatagcataaattgaagacaaataacaaactacttgtttcctccttctttggcatcaccctatggatggagtatgcatttataatttaacacaatcaagagatctttattatcctacttttgggtacaactgcttcgtttctcttttgaatctctacagctatttaaaaatctgttttgtaaaattctttaaaaaactaaaacatcagattcatatttcaggtatcttactatcttataccaacttaagcatccagtattatcacccacccttcccctgagtgaatccttagcactgggctcttcctgttttatccctgtgcatgctgagctctttctggccttcaagtctacttccgttgcaactgttgtctgaatggtctctctatgtccttcttactctctaaatatttcggaatttaaagcctggaataatctaccttagtccaaaagatatgctacactattctagttcacaatgatctcacactgccgttgatacacaacatttaatatcaacttaatatctatttcagttcattacgaggtcacttatgctacatcttatattgttgccttggacttttattatctcttcatatatgtgtttatggtgctcccaccctcacgagaagttgcaaataccatgttagctgtctgatggctttctatgttgtcaggtataccatttcccaaccagttggcattcaatgattaagttcattaacaaagaattgtatgtgttgaaaaagatgtttttttcttaatgaagcacttgtttttatttttttaatgaaatccaccctcttaataaattttaagtgcacaatacagtattgttaaatataagcaaaatgttgcatagcagatctttataatttttttaaccctacatgcctgatagtctatacccattgcacagcatctcaccatttcttccctcctccagcccttagcaaccaccattgtactttctgtttctataattttgactactttagatacctcatgtaagtggatgcgtgcagtatttgtccttttacgacttgcttattttatttagcaaaatggctacaagattcatccacattgtagcatatggtaagatttcctttttgtggcagaatgatattccattgtatgtatataacatagctttatacattcccctgtcaatagacatttagtttgttcacacctcttggctactgtaaaaatgctacaataaacatgggaatgcagatatctcttcaagatcctaaattgaattcgtttagataaatatccagatgcgggattgctagatcttatggtagttatattttttatttttttgaggaaactccatattgttttccacaaaagctgcacaattttatatttccaccagcagtctacatctccaattttcctacaccttcaccaacacatgtaatgatcttgggctttttttttttttttttttaataatggttatcctaatccgtgaggtagtatatcattgtggatttgatttgcatttccctggtagttagtgatgttgaacatcttttcatataactgttggtcattttaatgtcttctttggagaaatatctattcaattcctttgttcactttaaaaattgggttgttcgaatttttgttgttgttgttattacgttcctcatgtattttagatattgacaccttatcagatatatggtttgcaaaccttttctctcattctataggttgcttttaattctgttgattgtttcccttgctttgtagaagctttttagtttgatatatttctgcttatctagttttgtttttgttggctgtccttttagcgtcatatccaaaaaaaattattgtgaagaccaatgtcaggaaatttttcccttatgttttcttctatgagtttcatagtttcagatcttatttttaagtctttactccatttcattttgagttgatttttatgtatagtttaagttaaaggtccaattccattctttgcaatgtgtatatccagttttcccagcaccattggttgaagaggatatcctttcccagttgtgtattcttggcacccctattgaaggtgatgctaggtttatttctgggatctctattctgttccattggtctatatgtctgcctttatgacactatcgtgcgctcttgactgaggtagctttggtaattcattttgaaactagcaagtgtgatgcctccagtttattcttcttcctcaagactgttttggctatttggagtcgtttgtggtttcatatgaattttaggaaatttaccttatttctgtaaaaaatgcgattgggattatgataggaattacactgtatctgtagatggtttggatatatagacttttaaatgacacatcagatgtatttccatttatttttgtcatcttcaatttctttcaacaatatttcatagctttcagcacacacatcttttaccttcttggttgggtatttactaagttatttattctttttattgctattgtaaatgagattgttttctaaatttcctgtttttatgttgctagcgtatagaaacgcaactgttgaatgatgactttgtatcctgcaactttgctgaatttgtttattggttctaaccatgtctctgtgtggcgtcactcttaagattttctacgtatcagatcatctaatttgcaaacagatataattttacatcttcctttccaaatttgatgtattttatttctctttcttatctaattgttctggctagtacttctggtacgattttgaaaagaagtggcaaaagtgtgcattcttgtcttgtttctgatcttaagggaaaagattttcagtcttttgccattaaatgtgatattcactgtgggtttttcatatacggtttttattatgttgcggtaatttcgttctattcctagtttgttgtgtgtttttatcatgaaagtgttgaaacttgttaagcgctttttctgcagctattgagatgaccatagatttttagcctttgttctgttaatgttgtgtatcacactgattagttttcataaattgaaccatttttgcattccaagaataaatcctatatggctctcgtgtataatcctttcaatatactgttgagttcagtttgctagtattttaatgagttattttgcttctatatttatcagcggtattgttctgtacttttctcctagtgtcttttattgactttgatatcaggatactgatgccccttgtagaatgagcttggaagtgttctcttctctttaatttttctgaagaatttgagaaggattggtgttaattcttctttaactgttcattagatttcaccagtgatgacatttggtcctgggcttttctttgttggaaggttttggactactgattcaatctccttactagtttcggcctactcagattttctatttcttcaagattcaatattggtagattgcatgtttcaaggaatttgttcatttttttctaggttaacatacagttgtttacagcagtgtcttataatcatttgcattctttttggataccagttgtaatgtctcctctttcatttctgattttacttatttgaattttcctttttttttttttttttttacttaatctacctaaagatttgtcaattttattgatttgtttttaaaaaaactcttagctttgttgatttttctattgttttctatttcaattttggcttttttctgatctaatcttaatatttccttccctctgctaactttgggcttagtttgtccttctttttctaagtctttgaggaagaaaatggcaaggacatgactttctttagcagttggaaggacaatgctgtaaatactcaaaaattaattatttttatagtgacaaaaacaaaataaaaaacacttcaaagcaaatgaaagtttatcatttaatttatcaaatcactaagcagactgcttgatcagagagaagatactcatatgatcacataaaactgaaagattaagaggtaaggacattcatgttatcattacatctaactttcttatttccaagatggagaaactgagggttggagaaaaagaaagatttctttgttagatacaaacagacaggactaaactcagtatagcagcctcctaaattccaaagtatcatgatactgtgattttatgcattcttcagaaaaatagtagagccactggattctggcaaagaagttatataaaatgtcaagttcttcctttgcctcagaaatgaagttttatgttccaaaattgattgggaagttctccttatacctcacatcacgtctactattttacattgtttacttttgaagaatttttttaattgacaaataataattgtacatattcatggagaacctagtgatgtttttatatatgtaatgtatagtgatcagatcagggtaattagcatatccattatctcaaacattggtcatttatttgtgttgggaacattcaacgttctccttctagccatttgaaacttctatattattgctaactatagtcaccattcagtcgtatagagcactagaacttatttctcctatctagctataatttatttttaaatatgctttttgaatctgttactataaattgaatgtcacatcgttttgaaaatattcttaatttatgctcaacaggcaagattacacacctgtgataatatctttaatttaaaacattactctgtttaatttaccagaatatggaaccctagtcattttagaggtggagcaaatttcagtgataatctagtgcaaatttctcatcttatgaatgaggagattgagtctgatataagggacgagattttcgtcaatgagcagcttgttaacattagctctgtgatagaacacaggcacttgtcctcccaggccggtgtttcttctactctatgatgggctgttttgttgtagtttttaaacagcagcattttcaccatgcatagttttcttccaaagttcgttcttaacgtttttgcacagaataactagattttggaagtagaaaaaggaaattctctttgcatccttgtatctctggttattttctttgtcctttgatctctctctcctcccctcccctcccctcccctccccttcccttccctcccctctccttcccttcccttcccttccctcccctctctcacacattagagaaagagttaaggtattaaagaatacataatactattaaatttccttcacatagagaaaggaatgaaaaaaagtgaaaaatggtcctcaccaaatgtccaaacttctgtaggtcatttccatagtatcagcaatgtcctgtatggtgcctcggggatatgtaagcaaatgagcaagtggttagctaattctagctttggcaaacacttgttatggcttacttgaggagaagtcacttctccaaagtgaaaataatgtgcacaggtcaattagaatttttttgtagaaaaggaaaatactttgtagggacatggatgaatctggaaaccatcgttctcagcaaactattgcaaggacaaaaaaccaaacaccgcatgttctcactcataggtgggaattgaacaatgagaacacatggacacaggaaggggaacatcacacaccggggcctgttgtggggtggggggagggtggagggatagcattaggagatatacttaatgctaaatgaccagttaatgggtgcaggacaccaacatggcacatgtatacatatgtaacaaacctgcacgttgtgcacatgtaccctaaaacttaaagtataataaaaaaaaaaaagaagaaaatacctccttatgctcctgacttattttctttttggttcctcagtcctcttctctctctctctctctctctctctctctctctctctctctctctctcacacacacacacacacataccccacatatacaatatgattaaggatatatgtgaataatgaaagcttcttgtgtatagatttagaagtctaatggacaaaatcaatattttcctatgtgcatttaattcccccctttgatttaggtatatagtctttttttaaaaaagagaaaaaaaattaggtgaccttaaggtatagatcctactttcaaaaggtttacagaactagggagaggaacatggacaagatttaaagaactattttaagcagaataaaatgtgatttatgaacaaagcatatattatttgtgcgtatgtgtgtgtgccaacaaagatgcaattaggagattgcacagggagatgtcattagaaccaaccttaacgggtgagaagtctttgaagacatttagaacatggaagatctctgacagagggaacaaaggcatagtgacaaaagtcaagggcatatttaggactggagagtggtatgtgtggcttgagagtgggcgagaaaaaacaacaatgcctctgtaataggaaagtagacagaggcatgacattaagagctttgccagctgtgctaaaagtagtgaacaagagctaacaaagtgaagaaatgtaccttttctgatgtgtatcattcccttattcatatacttcttgagggggaaattcattctgtgttgatctagtaaactactacaggaccaaatgataaaaagaagtataggaaagaatgtttcagcatactttacgagataacttccttgtagctattctccatagtattttgagcatcacaaagcaatgagctgaaactgtctaagccaaaattgacttgtcatctgttagggatgcttagatgagaattctacatttgagagcttcttagattcattgaccactatgtcccattctaagatccatgaatgcgtgacctaactattacaccttcttttagtctgattgtcaattttgtattttcaattgtgcaagtttctaaaactattttaggaagataaatctagcagtggtgtgggaatagacaagagagaaggggaaagactcttcaggaaactaaactcacaatttatgagtattctttattgcccaagtcttcccaaagtctttcatcaagaaagaggcattgcaactctccttttatagtttgtttttattctggagcagtgatgttttggtggagttgttcctcagtgcgtaattaaagggcctatgacaattacagttcatctcctgctgctcaaggtactgcagatatttggatctactactctcattcatttccaattaatgtcagctttagatttccttcagtatgctatgttataaaatttgattatcgttgtgcccaccttcccacttaatttcaagcaggtttctcgattacctgactaaactaatgaaatctgactaacccaatatctgtggacagtagtgtgatgttactgatttttgtatgattagtcaagtcatattcatgccacgttttcatatagtaccataaaggatattcttctcgtggtccttttcttttattctgaacatacaatgagaagaccggtaaagtgggctaggaaattaaagaaaaatacaaatggcaaaaaatatgggtcactcgaagtctagaatagagagcacaatcaattttgaattaaggggtgataaggtgatttggtcaggtgactggtgaaacaggaaagaaactatactttttgaagtgtttcatccatgtgttaagattcatttggggtcaagaatctaaatttcatatccctgggagtggaaactaagtaaaaaaaaaaattatggaccttggtttaatagctagaggagcaagagtgtatctttatgtgacttaacttctatgtgaaaagtgaaccttaagattaattattgggggaatttacttactcaggttctatgcctagatggtctgcccaactaagaaaacttattttcctgttactccatcctatttttcatacttttatactgcacttgcagaaaagcatatatttctacccaatacgaaaattcctgggaacatatttttctacatttcccaaattacttcaaaaagtaaacttaggttatttcatgatctccattacaatggacaggtggccttattgaatgttgtcctgtgaatacaaagatccagagtttaaagaacaaggtgtacttgcatctcccacttagggtttgcttgtggtggagagagaatctagtttgcttaaaaggatgacagtgcagtgccccaaaatatctgatatcattaaaagtctcatatttgtctttcgtaacttctctagggctgtcgatgacaggagacccttaactcctatgccttgattatgtgaataagcacatgaaaatattttagttatcttagttcacttttaaactaagtttcaattatcactagattctaaatatcatcattgagccgttcttaaggaactgattttctacatattcattcacttcacctatatctagtgtgtctactatttgccaagaaaaatttactctcttaattcagcattccatatacttaacatcataaaaagtaggccatttttagttttctaaattatttatttaaacatttctttaaaattacattctatcattacactatatttcaacactacagtaagcagcctattttgtgatttttccttatataaaatacataattgaaattaaaaatgaagttaccaagagccattttcactctggggaatgcacatttataaattatggggttattttttcttcatcagctttcatattattaaactttgtctcttcataattacagagatgactagacacagaagggaatttaacatttggtgtgcatttgtctaacctatactttatgttagaaaatacatttccatttgaaaaaaaatcagtaattgtgggtgtgatcaagagggcagcctgaaagtcgggtgatgtgactcacacctgtaatcccagcatttttggaggccaaggtgggattatcgattgagcccaggagttcaaaaccagcctgggcaacacagtgagagcctgtctctattagggggaaaaaaaaaaaaagaggaagttagcctgaggcaatgtaaatgaaatacatatttcaaggatatttatacatgattcacgttattcatataaagatgtgccagagaagactataggtacgttattttacactattttgctaggattttaagaaattcaatgtgtttttatttcagttaacttagaaaacttacctaacttatacttctcatggacacaaaagtttttaaagataggatcaaaaagcccacatggtgaagcattttgaactggatgaaaaacatctattatctttaaaattttatgatattactgattgtaatagactccctttttaagaaatcattccttatagaacataaggtttacatttacaatcaacaatttctatccttactacaataaaggcacatataaaaagtacagttgcatatttagcaggtttaattgtacattttaatgtagaaatcaattcaattctttcatttatcagcattattacagtgatttcaaattaagcataggtaactttgatatagataaatgatgtacacagcagttaaattttattttcaattatgtagtaattgtataacctaggcagtataatttgtaaactttgtattttattattatgcttctcccacttggcataagcacaacacttcctaaaagcataattttctatagacttaataactccctaaaaacctgttttggacccctatactatttgatataggcagaaaaaaaacataatccatgctcaaatttgaaaaatgactggtcacatttggtataatactaaaggtaaataaaatcaagagtctatgaacatttccggacctgcacatttgttttattaaaatgcataattgtctttagtgtgtttctatttgtttatactctactgattttaattaaaaataccaaaatacgtttattaaaaaactgtcagaatctaagttgttaaatatacttaactaggaaagtaactgtttaaacgagataatttatagagaaatgtggtgtattgccaattagatgtcaagatacaatacaactgataatgaaaaagtagcattttcttagggatggaatacagtgtaaggaacaccccagtaagaatacaaaaattactgaaaaaaaatcttccttcctgaaaaaccaagtgcccttcaagtgcagaacctcatccaactaattgttaggtatcactaaagcctgataccttcaattttctggatcattcaagctgtatttttgagtccttatactagaggaggtaaagagctataaaaacacttaatggtatctgatgtgaactgtggatcactttgacccatcacttctacgtctacatcttggataaattcccattgttgtcatagattgtacaggtttaatggtgcgtttgtggagggggctcgcttatagaaaatggagactctgaagggataaggaataaatgtatcacttcaggtcttttatttgaaattggggtccagagagcctttttgtatcagacttgtcaaaccatttccatttagtaattatatatgcactagcacttattcctacttacctcacctctttatgcccatttccttgtagttgcggttatgcatgaataatttattgcaccccttaccaacaatggaataaaacttccattctgaaagctttccatactcatttccaatagcaatagggtttttttaacggacgtattacaaatgtacgagtcagttgaacatagtattcctctttgtaagaactccaagtggatgcatgctgttgtctcaaatctcaattagaccttgctttgaggtcccttcattgccagtcatctgttctccttcccctgacttgagtatttctccagatatagataatacattttcccaactctgtgttccaagaactgacagtggctttcattcattttgtttgtttgtttgtttcttctcgttctcaagtatcccgcagtctactgtttcttccctccattcgtttgtcctttcagagtttcaaaatccagcataggtacttcttctaaaatgtcttacccttcacatacacacaccacttgagaccccatcagcctctgtccacacagtttggttacattcatagactatttttatacatcaaaatatttgaaaattttagggtaaatctcagtagtcattcatttttgctcttattcaaccaatactagtcaatcagcctgtgccaggttttgttgcaggtaccaggtatccatccataaagaaaacaacgtccctttgttgtggaatttacattttagcaggggaggcaaagaacccaataaatatgataaaatatcagattaaaagtacgatgaaaaaaatcatcagggtaaaggaaaaagggaagcagtattttagcaagagtggtgaagagaggaggctgagagtgtgacatctgagcagagacctaaatcaagtcaaggaatgaaacatgctactatctaaagaaatgagtcaggataaggaactagtaagagccgaggcccagagatgtgaatatgctgttccaggaacagcaaagagactggttgatatgatgtgaaaaatgagaagaaaccttatgatatgtgtcaagagaaaaaaaaaatttaaaagcatgcttgggaacggaggcctccagatgaaaaaaaaaaacacagttcaaatccttgttcatgcatttagtttgctttgcaatcttgggcaaaatgttaaatttctgtacgttttatcttcctcatttttaaaataggcacaaggacatctacttaataggttcattgtgaggagtaaatgagatgatatatctaggatgcctggcattatatcatacacttaataatacactgaataaataatagttatgtctatttatttccttatcgtttttattattatttcaatgcacagacctgttcataagataatgataaatattagtggcagaaactgaagatgttataaattattaggaggcgggaccactcagttcaatgtatctgttttaatatagtcagcaaaagtgtgaagataccaacaattaaatttcaatgcattcttccatttcactagttttataaactgatgaactaccagaatgtcaatgtatgaattgcatactcattcttaacaaacagatttgcaaaattatgtgtaaaattagccctcagccttccaatttgttattgtcatatttcatggaaatacataatctgtaaatttttgttttaatgatatgtgaaactgcctaaagtagagtcttggcaactacttcacatttgtcctccagagatagtggataaaagtgtcaataaatgaacactctatattcactaatcacaggcaagggacaaggaacagagtggtcacaaaataccacaaaattaaagcacattccaaattaaatatatatgtttttattacagataatgtttgctagactctttctaattatctgcaaagattttaggaatgttttaatgttttaatatttacacacctgtgtatttcaagttcagtcaaacactattgttaaaactaaatcttctcatctctaataataagatgtgaacttatcttggaaggtggttattaggatgggagagataatgtatttcattcaaagtaaaaatatttctctgtttctatctttctctttctctgtcatctatttatcatctatatccaggtatctatgcacctatgtagactagcattcaatgaaccatagatattattagtagtagaattgttactaatattaaaataagaagtatttaagaagaaacatgtcctaaagcataaggtcaattattactctcatgttttttggcatatgaagcctaaaaagtgtcaatttcaagagagtattaataaagattgtgataactgaaaggttcctgcttgaaattttgtgtggtcttacaaatatataaactctaagcatttcagtgagccaattactgactaggcactatgtcttatgactcttttgtcatagtatgtaaaaaacaaagagtagagacatcataaaaattatagtagatgggcactagggaattacgcaaaataatttgtagatttaatgtgaaaccaaaacatctgttcaagtcaatttcccacaggtcatgtggcaaagagtatgagttccagactgaggagaggaaaaggttgttcttccacagggaaataaactgagtgtaataaacataatttttcttcttaagcattatttaaaacaaaaaaaatgccattaaatctatctttcctgcctctcttatcaatgctcccttccctttcaccacttgtttcaaactccaagccttgggattttattttggctttttgccttaatgtaactaaaatgagagcatcacaaatatgaagctcatcaaataatttagcagcattttcccctgtttttaactttctctttggaaacgtagatttcgaaatttaagggcccaaaatatgaaatgcaattataataggccatttgttcattcagcttgataaacttgaataaatagtattgaacttttaatgcaaaaagaacaaaacaaaatagaactctccacgaagaaacttttcaatgtttgcatttctgtgtgaggagaagggtaatgaatgtgggaaccttaatggaatccatgttcttccagtgatgacaagggtcaaaatggagaaaaatggtcactttctacccagtacattatattagttctatgtggacaactataacatagctgatgctggttttcaggccataaatgtaggtatgtattttcctactatttataaggcaaaatttctatttgtttaatgatttctatataggtagattattctgtctttaggattaaaaacgacctgtagaccaagagactttctaatgtccaccttagagtatatggcttttactgttacagtttccatttcctttgcttgcccctttgagagaaggaaaggagacatttgggatacatacatcaatgaggagctattaatgaataaatgaatgaaattgtcagtcaatttatccacatgatcatcaattgccaataattttatcacctctgtgggattaagtagaggtaacagtttagaaatttgattttttgaaagcatttaaaatgttcaaatatatcactctggtaactaagggaaagtgtattattttcttatgcttagtcttattttggttttgcctttttaatttaaattgaacacttatatcaaagagcttgcaggattataatttgaatttttgaagcaaagatcattttcttaacatcaaacaaagagtagatacaataggaataaaatcggcagaaaaacaagagtatcaaggacagacggggagggtgggtctgtgttagcatgtattgctatgaagaaatagccgagactgggtaatgtatttttaaaaagagctttaatcgattcatgattctgcaggttgtacaggaagcaggacaccagcatctactcagcttctggggaggcctccgggagcttttactcatagtggaagatgaaacaggagtaagcatgtcacatggccagagcagaagccagggggaggttgccacacatttaaaaaaaaaaaaaacaaaacagatcgctcaagaactcagctgctatcatgaggacagcatcaagctgtgagggatccacctccgtgactcaaacatctcacaccaggccccaagtccaacacttggcattatatttcaacaagaaaaaaagtttaattggctgatggttctgcaggctgtacaggaagtgtggcacaggcatttgcttggctcctggggaggcctcagggagtttttgctcatggcagaaggtgatgcccacacactttaaaaaaaaaccagatctcatgaaaactcactcactacactgaggacaatacaaaaccatgagggatctgtccccatgacccaaaaacctcccgccaggccccaccaccaacattgggaattatatttccacttgagatttgagtggcggcaaatatccaaactatatcagggctcatgtccagttatatgtcaacatgcctgcattcgaaacatcctgtccaaatcactgccttgtcataatacttatatttttctttattgaatacgaacacaagaagattaaataatagcatttctactttaaaacagtgggcaccatattaacattggaataatagtagtaataacgatagtaataacaatgatataggctgggtgcggaggctcacgcctgtaatcccagcactttgggaggccaaggcgggcggatcatgatgtcaggagatcgagaccatcctggctaacacagtgaaaccccgtctctactaaaaatacaaaaaaattagctgggcatggtggcaggcacctgtagtctcagctacttgggaggctgaggcaggagaatggcgtgaacctgggatgcagagcttgcagtgagccgagatcgtgccactgcactccaacctgggcgacagagcgagacttcatctcaaaaaaaaaattaaataaataaataaataaataataacgataaaaggatatgtgtaggttttttttttaataggctgttaacattaataggcattgtgatttcagggatatcatcaaacatcctggtcctaagacatcccctattgaataggaagggcttaagttaaacttctcatgagccacaattttctgattatatgtttggtgtgtgtaatagccacctcagtgatgatttgattagcctggacccttacataatcattgaagtatacccatgttcctttatatacttctttagtgttgaaagctcaaaattaagcaaaatagtccccttgataatgtttagattcttaacatttgctttctaaagctggcaaatactctcttcccagtgtcatgaagttaaataacatgttgcttagtgaggactttaatgttgccatgccataggaagaccttattcgaaatccccttacctgggagaatgtcagattattaccccccaacttgtttaacacttttaggattttaaaggtgttcacatttgtattagaacaaaatactattgagaaacatttctagaaaaaaattatctttccaaattaaaatcagtggtatgtaatgtaggagtctgattataatgattaaaatacatgggctttgggcatactgcctaggtgaaactcctggtttattgcatcactattagtataacctatgggagttaacctacgtaagcctcagttaatttttctctcaaattgatctaataatcgtctctcataggcttgttttgatagatatttcagtgtatataatatacttaggacagtgcctgatatcagtaagtctccttatatgctatttttctttctattttaattatttatgcaagagaaactattatgctttaactcaattaaaataaaatgcctttgtatttattcatgtcaaaggaaatatgcaagtattgcattcacttcctaggtgcctttttgaattgagctttgcatggttagtttgtataaaaggttcagtgaactttctcataatgattttttattgaacatatggaatccattaagtgttagcaaaagtcactatccactgagctgtgtccaggggctgacagttatgtctatctcttgcaaaaataaacacatacataaatgcactaagacgtatattacctgtcgtcatctcttagagcatttccatttttcttttaagttttttctttcaatgggttttttatctttgtgagtacatggtaggtgtatatgtcaacggggtacatgaggaaggtgtatatattgatggggtacaagagaggttttaacacaagcattcaatatgaaatagtcacatcatggagaatgggttatctatcccttcaagcatttgtgctttgtattacaaacattctaattatactctgttagttattttaaaatgtaccattaagttattactgactatagcaaccctattgtgctatgaaacagtagatcttattcttatttttctaacatcttagaacatttccacaaacactacctgcttgttaaatatacctattctaatcttcatataatcaattacttttttcctctagaatgtactatgacacatccatggggaaaatgtagtaatctaattaagactatttcctctcattttatatttaaaagaatgtgctctatcaatttatttacttgtacagccgtaggcaacctctaaaatatttaaagttcttaaaagtcagatatttcagttaatattgtgattatatagttgattttgatgaacatgttcatctaccagaaataaattatacacacacattgatatggttaggctttctgtccccactcaaatctcattttgaattataatccccgtgtgtcaagggagagaccaggtggaggcaattggatcttgagggtggttttgcccatgctgttctcctgatagtgaatcatgagatcagatggttttataaagggctcttcccccttccctcctcactcattctccttcttgccaccttgtaaaggaggtgccttgctttctactatgccctttctactatgcccttcaccttctactatgattgtaagtttcctgaggtctccccagccatgctgaactatgagtcaattaaatccctttcctttataaattacccagtctcaggcagttctttattgcacatatatgtgtgtgtatgtgtatgtgtgtgtgtgtgtatatgtatgtatatatgtatacatatgtgtgtatatgtatgtatatatgtatgtatatatgtatacatatgtgtgtatatgtatgtatatatgtatacatatgtgtgtgtgtatatatgtgtacatatatatatatatatatatatatatatatatatatatatgaacagagagagagagagagagggaggaagggagagagggagggaagcatggagaaagagagagtaatagcctaaatagaaataaaactagctccaagtacaggttcgtcaacactctcctatcatacccccaccaaagttaatgttaaccacttggagccctgttcttccttagttgtggagtactttagcaaaattttaaatctaattatgcctaattcaacgacagtgctaatttgaaagtgttagaaactgaagacctataataataatgagagttacaaaacataaatagtgagacaatgatgaatgtagtggatgcatgtacgagggctatcatttgacagtagagatgatgctcaaggacagacaatgagtctttcaatgtgtggagaatgtgctgctgttacagtgatgtacaggaaagaaacaaaaactgaggaagtatcagtaaacaaaacactcaaacatatgagtatacagctagaataaaagcaacagtactagatgacaataagcccaatgttaactcagaaagcagaaggtttttaagaatttggggaatactgtggctgatgatacttatgtctcaagccacagatgccatatgggctctgcgcccagttgaatcggcaccacctggcagtaagtgggcaggtccacgactgccaggacatcccttccaacacttgtggagatcaccaggaaggggggagagacctgccttgacagattttcaatgtgggcgaaacaggtctattttgagaaaagatgttcaatagaacatatgtcagcaaggaagaagagatgatgcttagttctaaagctccaaagagctggcttacactccaacttggggaaaatgcatccgggaaatgcaagattaatctcatcttagccattcttttgaatggatggacatgacccctttctacttgaagacagaaaacataaccatattgatttcaggttttcttcattggtttccatttaggattgttcctccccatcttctttctgtgtaggcatcccagttcccaagtgttcatgaagcacgtatggccttcaggggatgtgtctgtatacattgttatcttatggatgcacggttttgtctgcaccttggttctgaatgtctttactcttgagcatctgcccatgggtccccttctcaaggcctcaatttcttgagtttaacactgcatggcccatgcagcttttcagttaagcatctcttgctatgaccaactcttttcctcagtcaactcccacactcttttcagggacaggaaaaatgtagccacttgctggctgcactctgaggcctcaagaaatttagtgaatctgcctttgcccttcttgctgatgaaatactgccacatcaggccccctcttcggaaacctacaagcatctaattttcttgcttcctccccaactttctttttgactcccccccatccagagagttcttatgtctactgtactaggaaaaactcattcttaaggtatggttttcaaatcattctctggtctggactttagctacggttttaaatgaagaaacaacccagagccaaaatataatgaaactatttccttcttccacagagtggaaactgctttggggttaaagggccagtgaaccaaatagaaaaggatctcagggaacacagattgaagagagagaagaaaaaatatgaaggcattgttggttctcttttgagtttaaaatctagtggggattgtaagcacacacacatatacacacacacgcttacacacacacaccagtgaagttatgaaggattttgtcactccaacgaccttgaatttgattatctaggtcagttgttaccaaagtggaatgtacatgcccaataatatgcgtgctaaacagttggggtagtgagaaaaaatactttttatttatcttgttctctagaaattaatattttgattgtatattttatagtgtatgtgatgtgtaagttgtgtctacaaaactagtgtcaatgtaatttaaaattacatatgtctgtgaatatatatttatatagggtacatgcttaaaatgtgtttacttctgaggtacatgaacatttttcccccaggcacagaaagacaaataccacatgatgtcacttaaatgtgcaatgtaagaaaagttgaattcatagagatgtagagtagaatcatggttaacagaggcttgggaggtggagtgagggaatagagagttactgttcaaagattacaaagtttcaactagacagagggaatacattttgagatctatttcaggaacattttgagaccctcactctaagtaataggaaatcattactttagttaacatatttgaatatgagttgtgatgttctatatcgtttatttggattctactaacccacacctagatttttatggcattacctttttactcactgtgaatatcctactcatagacagatgccctgggaacttggacttgaggcacccaagaactgagacagtgagatttgggggcacaaggatctatggataagttcatcttagtgatgataaaatcaatttggcatgtttcacggacagtgtgcattttagaaagggtaaagacttggaaacgggatatttttgagcccaagtgtttccaataaatagctgtataatttgaagcaaataattgattttttgttctctttgtgccctcgcctgtaaaatgggagaaatgtattcctttctcatccttctcatgaggccattgagagtatctaatgagatcagactgtgacatagcataataattctcatttcttgaaggcctattatacactttgcaagcactgtatgtgttgtttctacttctcttgttcgtttttcctggaataaatatccccccctcctttacattggattgccattattcaccctgtaaggaaggcttcatggttctcattttcatctgagaaaacttaggctcagagaagatcagtaacttatctaaaacacacacatacacacacagacatatctatgcccattattcttaacctagtttctctattcaggagttatctctgctgtctctgcttctgattataatctgtgtaagctgatccaagtgacacgattacagggaaattgtaagccctttgagagcagagactacctattgatatctacattttaaaatttgattttagccaacctgtttatatgcaatgactaacaggttagtttgacttgcaataaatattccaaatcctagactaagtaaatttattaatgtaatgatttaacttgattttttcattggcatgtttccctgaagtcgtcatgcaaaattgaaaaaaaaaaaagtatagtgtgtgattctagattgaaattcaggaatcctccagggttaccttgtttgctttccaaatagttcagattgcttagtctgaccaacaaggtccctgacacttggaactctgtctatccctctaattgactttgtccctgatgacctcgcccagagatactcttcaccccagctatactgtgttgctagagtttctctgatatcccatgctattgtttcctttgttctcttcataaggtaccatttcccacccgccaactcctgttttcctgatggacttttgtttcaccttacaagatcattgctaatgtatttattttgagaataaaaagtgtaggaaaggtcacgggacaaagctgtacaccagacctttcccagacgaacctagtgtataatctccctagtccaacatcatggcttaaggcagtcgatagatccgtcttaatgtcccttttgagttttctactattattatatgaggatttatttttgtctgaattcctccctagatttgccctagagagcaatgactatttacagtttattcctctttgtatctcttatgttaaggccagaccttggcacatattctagctgattagaagacgtttgttgaatgaccaagtgattgaacaaatgaccatgtgctctgccacagtccggtcagttctactttggtttggttatgtgtttgccacattaaagttgtagcctgggaagttcagttgtgagatgtctgcagaacatgaaaaattggaataatgaggttatttctaaaattgctataatttaaaataaatagtggtttattccatatatgaatatacactggaaacaaagaatttctagaatactggagattcaatgataacatcattgaaattaaataaataataggattatgctagttactttctaatttactagaaattgaccgtgtgcatggcacgtataatgagtatcatgggatagttacaaaaagtggtgcttagtgagtttctgtggaaaatctcggtaccaataaaacggaggatttccagaaatcgatattcctcaaagcttgacagtatttatgcacggttacactttgtgtgtctttcgtttgaatcaatggaaggaggctataactgaaaattattgttttagtgtattatatctttaataataagagttttaagaatctatcattagaaataattattcctcaatttgtaattctcaacatttgaacaaataaatgctctgtgtctatcagttaatcttgcccatgaagatttaataaagcacgctagtttttacaaatgtgattttagagatggtcattacttggtaaaatattttgtgttaacacttccatgaatatgttctgtgggaatatactgcctccacattgcttgctcatgaagacatgatttttcacatcatcctatcagtattttgagaaagagattgatcccatattctatgagcatttgaacattctctagtatttttgtttaatcattaaaacaacccttgaagtctatgtgctacactggttatttccctcttgactttcctttacagataaccctctatcataaacaacctatctatatttgttgtctccacatcatgttgccagccctgctttaacacactgcacattgacttctagcagcaaaggctcatgggaggtactctcatcaaggacactgatggtcctcatgttgctaaatttggtgggtcctctacagtctttatcctagttcaccttattatggaccactgtcaactctgttctgcttaaaacactctgttccttgcttatatgactctacactcttaactcctttgtgaattcctcatctgcccttccattaagtattgacgacatccttcatagttttgatctaggacctcttttcctcttacttgacattatgtgggtaatcttgtctttgaacgcaattaccattcttatgttgatgacccttaagctataattccagcccaaatcatttttctgaggaagctacaagaatacacaaatgtctaatagatctctatttagatgtccctcaggtgcttcaagcttaaaatactcacctgagctcatcacctcatctataaattctgcttctcctccctggctccctgatttatttaatatgaccaccatccacttagttgaataaagcagaagcctggacaccatctatacctccaattaatcactaagttttgttgttaaatacgttcttacattttctctctagaatgtcttattttccccatctttacacccaaaaccaaaagtcagatgaccctgatctcctgcttagatttcaaaacactatctcttgcctagactctggaatttcagtcttgctcctctccaatctatttctacaccctagactctggaatttcagtcttgctcctctccaatctatttctacacaaaagctagagtaattttttaaaaaacaaaaatctgaatgtgttcattttctgcctaaaagccttcagtaattcttatttgttcttccagggatagagtaacaactttcagacctagtttattagctagttctttaaccacaaaggactctctcacttgtctactccccctaacacacttcgccctaacctttgccattcctccctttcccttttccttcccagatggacttaagtcctttcagattcttaaatgtttcttcctccagtctcttacatctcttttccttgtaactctaaaaactacttagcttacgcaaggaaaaaggtctgtacaattcccggaatcagcgatcctaacgttccctgttgtttttttcgttgggacatgaattcattcacagtggctctaaacatcaccacccctgcctatctctcccattcctactttatctgagcttatccatactcttgaagacttacatattttttttctaccaggaaatcattactagccttattatcccactgtccaaaccaataagtctgattaggtatctgtatatatttaatattactatatgtgtttttctaacactctagtagaggagaaggtgtatttctttctgttttttagaagcctgtatttctgctattatagctcttaaggaactctcatgcaattgcctactagaatgtaagttacggtaggataagaactggatcagtcatatcacacatccacatataggacctagcaccatatctaacacacagcaggtactcaatacatttctttcccaaataactaaagagtttaaacaaaccaaaatgattaaatgagaagtaactgttttggtaattcttgtgtccttactagagtctaaattgagtgatttttatatcatcagtttatactcccctttcccaaccccaattctttcttttttaaattttttaaatcaaatatgccttaaaacttcaggatcagttgagtaaaatgatgcttttgtcgtcttttgcaaaataattgtatttcagaattttgatttagatattataaacacacctaaaataatagctttagtcttaagatgaagtgcttcttaaactccctaagatgggttggactatggatatgaacatggacaatatcacattaatttgtgtacacagttctaacacagggtctggcatataagaacaagtcagtaaatagttgttgaatggaattgaaaatttaagtagcaaataaagtattttgacctacaaagcaagaaatcacatttttctttttgtcacagttccttaggaagataattaattttttagtatttaaggatgttaaatatttattttatgttctatttactaggcttctttttatgaaaattaattggtgaaaatagcgtacatatcttcctttaccagaacatttacattttgggcagtaacgctggcttttgttaaaaaagcaaaatatgtgtgaaatttatgtttgagttgatttcaatgcattacatttccattttaaatcttctttgaaatactctatttttgacaccatgaaactgtattagatcttagtatgttagcaatgttttgcagttttagagccataattattttaatgaccactttcagcatatacgttttctacaggaaaaataatctcaagaacatgaaaagtgaaatctatattttgggtttcaaaatgatacattttagctaaaatatcatagttttaatttctcagtgaaaaatatagtgtggtaatttatgaagagactcagtgtttaaaaattatgactctatagtcaagtttatgtttataggacataggttattcaattacatttaaaataattaatttagaaaatgtgatcaatgtaacaaattttacctgttcttttctaaagctaaatttgttgtttgaagtgtttcttctaaaatgctaatgaactatcaatttaattgttgagcttagagttagaaacttaattatattgccagaaataaagaaacaaatggatcccaaaagattcacacattagaaatgtatgccagggaaatgcttttgaatgtgttcaagtcatggcttctaactcgtaacttataacttgtgttatgtctggcttcattcccttaagaaaaaggaataataatgccttcggagagcatcccagctgtaagagctatgcattggtgtctaaaaaagcttctcactcctcataccatcctggtctgggaatttaaaaaattgtcatcttttgataatctgtatcacatagtcttctgcatagtcatatgaggttagaactgccccataacttttgcagggcctatagtaagtgtgcaaatggttgcctgcatgccacatatttaatatttataaggtataaagtcaacagactattaaatatatcctatctgctttccttgacaattatacaatcataatgatatggacatctagattcgatttagaattctctctctctcattttctttttcttctttctttctttctctttctttctttccttcctttctttctttctttcttctttctttctttctttctttctttctttctttctttctttctttctttctgtctgtctgtctgtcttgtttttttaaatagtgcaagcagtttattccctggcaaggaatttggaaaaaactcaaatagcaaaccacttgatacaataaaataaattccttagagttttgtactggaatgaggcagcttggttagagctaaccctaagcctgttatttaggatacattggcttttcttaagcttaaaaaaaattttactgtgttaatgacatttaacatgagatctatcatcttaataaatactacatgcacaatacattattattgactctaggtagaatgttggacagcagatctctagagctaattcatcctacttaactgaaatgtaatgtctgttgattagtaacttcctatttcgccctatccccagcccctggcaaccaccagtccagtctttgattttatgagtttgactgttttagataccttatttcaagtaagtggaatcatgcagtatttgtctgtgtctgtcttgtttcacttagcgtaatcttaaggtccatccatattgtttcatattgcagaatttccttttataaaggctgaatagtattccattgtgtatatataccacatttatctattcatctgccaatgggcatttaggttgtttctgcatcttagctattgtgaatctgttgccttttttccctacctcctttactccatcctgcactgtgaggaactctgtgcacatagatctggtcgccccatttcccacccacatgttcaagtttttcccactcacctcatgcaaagatttaccccttagccatacccagtaactgactttgaaacatttgcccagggagttgagggattctgaatgccagatcatgggagcggggcttctagtgagcatgttggcttggtcctacagactcctaatcagagctttgcctttgaaagcatggggcccaagggcaaggaccctacttgttaaggtctaaattttttttctgaaataaccacatcgagcttttatgtgtagatggcctaaattgggctaacccagaggcagtgacactcaagtagtttacatctaagcgctttccatgtgcttcttttcccatttctgttacttcttacaaaataaaaaatcagcatctcaattaccctgatttgatcattgagcaatctaaaaagtatcaaaatatcacatgtagcccccatatacatacaactgttatatatcactataaataaatatatacacattatatttaaaaatcaatactttaattttacatgtttaacaaatcactagcatatacattccagattgaacttacgagggatgtggaaaagattcagtgactaaataacaataaagtactctaaaaatgaaaatgtgaaatggagacagtataaatctaaaatcatatcacttatgaagtattgtttcaaataaacaataaaatatatcttcaatcaatttaattttattttagttgtataaaatctttcggtcagcattaacctaattggaacactaaataggtacatctaaaaaatataatcccccccaaaaatatgtagctcataagagataatgcattgaacacagataatattggcgttaaaaacagaactctaccacatttgcaacgaaatgtttatctgttcttcctactagaaaataataaaatagttctgcatgagcttgaactcgaagtattaggtgtacaaagaccttttagtgaatgaatgctagctgaaaagcaaattttaaatatgaaaaattagcaagacaaacatttgaatttgtgggagatgagtaaaactcctataaaaatgaattgtttagtgttaaacagattgtgtatgaaatattaatggcatattgtcctgagctccccttccgctgtttccatgtagatgactgaatttcaaacagaaatatgccaggaatgattacgtgaatgaatattactacatgagattgcttaaagagtatttcttcttttgccttctttttactttcgttatttcatttagtagttagaaaatactgtctacaaatatgtgagaactgcttaatttatttttgagacattaattaattcaactaaactatattgactgtgtgagagagattcccttggtgaatatgtggatttttgcggtggtaagaactctcctctggagcgcaaatggtattgctctaggaataaagcatatacctcaggcccagatgaaccagtgcaatctacagtaacaggttcaaagatgacctcatgacctactgtggactaataaaaatcaaggagacctactgcaaaggtttctgggaaattctttttctcttgcgttgaactaagtaatatacatatgtgatagttagagctgcagcctttgtaataccatgacagaagataacctgaaataaggctgacagacacaagagggagacctaagagtactgagagatatggagcaggaccccctgattgaacttcacttgcagcccccttctgcagttttcaatgacgtgaaccagtagaatccctttgtttactgtttttgattaatttgagtgcagctttatgttatgagcaactaatagcatcctcactgtcacaactgccctctatacggcaggcactttgtgatactaaagaaagcagtatacagagtagagcccagtgaataacagggcagatgttgcaattaaactgcctgtttaaattctagctcttccactagctaacttgtgactatctaagtaatttaaccttcctataatcatacctatcttgaagacttgttgtaagatttaaagcacaacagtgctactataaaacaggtatacagtaaagcttagctacttttttattaggccatatgatatcatttcattaaaatcttatagccatgctataaggtattatgatcctcaatttataaataagacagctcaagttttggtcaagtgactttaccaaggtcatagagctagaaaataatgattccaagttacaagccaaacctcttcaatgccaaatttacatcatcccccattacttgaagtgtaagattcacatggacagaaatttttgactgtttgatcactgctatctccttatcatctaaaacagtctctggtccatattaggtgttcaataaatatttgtagagtacataatttccttcacagactccacaatctggtgaaggaggcagacatgtaagagaattatttcaggattccacagttgatgctgtaacagagctaaatataatgaatggaggaggaatgaataagtttgtctgggagcaatgctatggctattgaaataagtcttgctcatgctttgattgaaatggtggatatagatcacacaacaaataacaattagataacagcttgttgggagaaagcgaggatcagtgtttgccataaacatttctcatagctaatgtcaggtgtttgatttctcaacattttatatctttgactttgattttctctgtttttattttttaactccattctcaagaagtctgcacataagagtttcaacatctagcacttcataactccgtcatctcctctcaggcttagagcaaattctgagacgtggatttatcgtcgagtgatttcttcctggcattttatctctgagaccaggatctggttgctaagcatgtagacatagaaatgcatttcttcattgaaccccataggttcaaactagtggataatgagcacaatgtcaatgtgattatttgtaatgggggaaaggttaccggagaatattacacgaccatccacatagactaacattttcctcatgactaagtttacttagcaaaacaaattaaaaacagaagtttgtttagcagcacagaattgaaggaagacaaccagatggttatgaggaagattcatccaaactatgccagaactgaaagaaattaagttcattcagtacaagaattgtctagaataagagaatccattttgtgtcagcacttcccaagttcttgttaatgctaccttaagttcaattcaaaccaggcagcatttattacgtgttgtgctgggtcctaggaggaccgcgttttaagaacttactgtgatcttctagatcaagtttttatttcaatatttctacctcatttctgattcttaggtgttccttatttcccaatttatcccctgcagaaattgaggcaataagatgtctatcttattgcctatggtgttgattatttatgttatattctgttttgtgaagtttgacctctacctaattaaattacattttcaattgtatcttggattgatttattcaataagtattctttaatatttttgcatgaggtcggtcaggtttcatcagacattaggaattaattataaaaatctctagattggtacttggagcttaaaggaataaggtggtggaacgttaaatgaggaggaaagaaccagcagagctgggataaaattcatctctatcatcttcccacctgcttgatctctggcatataatttactatccgtgaacctcaggtttctcttcagaaaagctgcagggttgttgggggaaataaggcaattcctgggcttcagtatgttcaaaacagagcattaatattattatagacttttgatgatttacacaattttagctttttggcaagacatatttactagtactaagtaaaagcacgttgactttctaaaatgaaaatgtgtatgtgaggatgaagaaaaagaaagtgttttgtttgataatatagcattataacactgcacaaaaaaaaaatggtatatgcagagacttccatcacttgcttatgatgccgcattgggatctcattaataagacacttcctcagacacttcctttgtgttcaataaatttcaatttcctcctttccttcagttcacttcaagaaggacggcagcaactttcttgttgccaaacctgacaaatgttttttagtgctgattatactcgagcattctgtagcaaaatgctgtgggtgaaaatgccttccttcttaagggaatttagcttctgtagtaccagaatctccttgttgaatgaacatgtactgcctaagtcttagtaatccctcctttttgagcccattttctggcatctctccctttaatattcctcaaaaagttggatttttcctggacttttcatattacagactttcctttggtcatcctcatccattccgtgattccaactacattttccctccatcctggcatcttctttcttccagacttgtatatgcaactgcttccattcatacacttgaccaaccttttaatttctataagatcaaaaactcagctcacaagctttcccctaccatcgagcggggttcttcttttgcttctttgtttcagacaatggcaccaccatactcgagtaaggcacgttcatttatcaggtcctaccaaatctacaataaactctcttgaatttatccacttgttttcatttgaacagtcatttctttacctgggtagcctgcaccttctacctgcattgattcagcagtctcttcaccactggctctccctccctctcctgcctctcttcttgctccttcaatttattctctactcttcatagtgacttttattaatgcaaatatgaccttataactcccttgcttaaagacccactcatgtttgtctttgtatccataacttccggcctagggcttaacgcatagcaggtgctcagtaaatctgtggtagatgaaagaacaagttgtataaatactgaatggtctgatgtgctctttgttgtgtcaagaaggacattttgcagtcaggatagctacatcagtcctttagtaggcatttgacagcactcgcattattcctcaagagaagatggatgtattgattctgtatttcaaatgacataacttttgtgaaataagaggctgccacggtaatctgagggatctctcaagttcaagggactccacagtgctttgtgtaaggtaacaggctaaagggttcagtcttaaactttcttaagactgtagttcagggttcctatggtggggctataaccctgaattacatcctctttcatttcatgctgataatgagaactacaaaccaaggggtattaggaaagaatccaggtttgatgcagggaaaaataaaaacaactgataatctctagtgtccccaacttcaagaattcctttcttctttacaccaagctttttttctctgccaggacttactttgtcttctacatgtttaagggagaaaaatgagttaacagaaggggaggtacagcatttctatttacttagatgctagagaacaggatgaaaggtatgaaaaatatgaaagtctctctctctctctctccccagccttcccccgcttctctctctctctctctctctctgtgtgtgtgtgtgtgtgtgcacgtgcgtgtgtgtgtgtgtcataatactcaacctttcttttctttcaagcatatgttgtggcagagacaagtgtacatcaaaattcgtggtccctctttcatagtatagagttcttgctaggatccagctgcaagccagcaactacatttcccagccccactggcatctagttagagccatgtgactagttgtgaccaattgaatgtgagtgggagttatgttgcaggcataccttttccatcttcttacttcccatttgctaaccttatggaaaagagtcccaaagacctaggagatgaaaaagcctaaaatggaaggactcagagtccctgaattactgggtagagaaaagctgtttgcagatgggaatgcccattttgtagtattctttcttttcttaagccactaaaattgtgggatctctttgttatagctactggcattaacctcttacgtatacatacagctatgtgctacaaagaggaatagatacattttttaatcgttgaaaggggagaaagaaacatatttaggaggaaaataatttagtctctacaattgaaaagtgttttatgaataatattttgttttggcagcatattaaatctcaggcagctgaactacattaattttcaattctctatatatgtttttgtcttcagggtttagtaacactgatatataacagtttctttcttttaatttccaaatttaaatgtctaagtttgccttctaggcagaaattaagtcccattgtggaatgagattggatcaacacttcaccaagatcattttagttctttgtaatcttaaatgaaataagctaataaagcattaaattagcatgttgtaaaacttcgtgaagttttaatatgcttctaagtggcagctcttagcttattatctctaaagctaaagtcaaaataaatgtctcagttgatgaaatggagatgaggcaacattttatcaaatttaacaaaatattttatatctgaattataaagtccagattatctagtaattatcatataaatgtatttaaccagacatgcatttttctctaatcagtagccctggagtctttggaccacaaatgtgccttatctcaaatgctttaactgtgacattttgctttagactagctcgactacttctacagaaattatacacttcattcacattcatccagatgaaaaaaatacatgtagaaatgatcataataagtaacatttgtttaggatttcagagtttacgaagggtttttctattcactttctcacttgttcttcatgtaaactggtttggtggacaactgtcattatccctgttacctggagcccctgggtcttagggagacttcttgacttctcaaggtcatgaaggtgctaactctgaccgtgtttttattcctactgtgccacacttctcaggtaaaaatcatattgcagacactttaagagaagtacttaagaaaataaattcctccagagaattacatttaagttgtttcattaactgcagtgcataaagaaaggaaaagtgttcccaaacccatgtagtattttgctattgcttatggtaatattctgcacacctaatattgtcagcataattttccatgtaacaaaatgtcctaaatcagcaatgtccaatataactttgtgtgatgataaaaatgttctgtctctgtgctgtccaatacaacagccactagatacacatgactactgagcaatggtaatatggccagggacactaaggaactaaatttttatttaatattaaataacgtttaaatttcaaaagccgcatgcggctagtggttgtcatcagatactgcagttatagaaaattagaatttacctctttaaatactaaacctatttttaatagtaggatttttaaattaaaatagttctaagtgcttttaagtgatacgaagtcaaatgcaagatttctgttttaatagtactctcaacccagagacaatcttcatgcatccttatacatgttctttgttgccttattctagttttattttaacattaaatgcctctgttctacttgatattgacttgcttcagagaacaccaagtatagtggaaagaaacacacacatgaggacttgaggctaccaaccaggttcaactaaatgcactctgatttaattgtagtattgggatcccctgttgcatttattgaagaagaaaaaaactttgcaaccaaaaagatatttgaaagcaactgttcttcttggacacatgatccctcataaagtggggcttcctgcttttcagagacttaatttctgttcatattcatttcagcaatagtaataatgatgatggcgatgatgataataatcatgatgatgcctaagtgttgtagtaatgcttcttctgagccagacgttagtcaaattactttctctacattaattcaggcaatcatcacaacaatcccacaggacaggttttattattatacttatttagctagcaaatgatataactaggttaagttacttgcccaaggtcatactgccaagacagtggctctagtgtccctgcttctgaccatatgttatgctgcctatcctagagcttttctcttctaaaatagtaaaataatatattctttgtttgtttcatacttttttttttttttttttttttgagagggagtttcgctctttcgcccaggctggagtgaggtggcgcaatctcagctgactgtaacctctgcccccaccaggttcgagtgattcccctgcctcagcctccgaagtacctgggataataggtgcccaccaccatgcctggctaatttttgtgttttcagtagagacagggcttcaccatgttgaccaggctggtctcgagttcctcagctctggcagtccgcccgccttggcctcccacagtgctgggattacatgcatgagccactacacccggcccatacataaatattttaagcgaagtacacatgcatgatcatcatacttttaataatttcatttaactgtttccaaagaatgttagtatgaggttttctttttttctttttataatttcaacttttattttagattcagcgggtacatgttccctggatatagtgcatgatgatgaggtttgctatatgaatgatcccaccacccaggtagcgagcatggtaaccactagttcttcaacccttgcctgttcccttcctccctccttcctctgtagtccccagtgtctattgttcctgtctttatgtccatgtgcactcaatgtttagctcccacttttaagcgagaacatgcagtactcgttgtctgttcctgcgttaacgtgcttaggatagtggcctccaattgcatccatgttgttgcacaggccatgattttgttagtttttatggctgtgtagtattccatggtgtatacgcgccacattctttatcctgtccaccattaatgggcacctaggttgattgcatgtctttgccattgtgaatagtgctgtgatgttatatgtactttttggtatattcaaagagaaatgctattttcctcttgacatatttatgtcaatttaacatatttatgtcccttttctttttaggagcaccattctcttcctttaacattataaataaaatattttttgcttttctgtttttgtaagtgcagttttattgacagagtgagacatacacgtcgatattgtgactagctgcatgtcttctattatttagaggtctcactcaaatgtagattatcaaattctgttagtgaagagggtagaacagcagaactaatgctggtttccttctctagcattatttgatgataaactaagatgataataccccccaggtcttagatacctgcagtaggacaggcaccctacatttaatgctcctaggaatccttcaaagtgatagcatagttattatacagtaattgagaaaactgatgttcataagttagaaatttttccgaagttgcaaagaaagtgaatggaagaattataccaagttctggccgggcgcagtagctcatgcctgtaatctcagcgcttcaggaggccgaggcgggcggatcatgaggtcaagagattgagaccatcctggccaacatggtgagaccccgtctttactaaaaatagtaaaattagctgggcgtggtggcacgcacctgtaatctcagctactcgggaggctgaggtaggagaatcacttgaacccgggaggcggagtttgcagtgagccgagatcgtgccattgcactccagcctgggcgacaagagcaaaactccgtctcagaagaaaaaaaaaaaaaaaaaaagaggattataccgagttctctttgattccaagcccaaacaaatccttttttgcaatatatgacattgtttccctgtttgcattccccattctgtgtatcacacatcctgtggcctgatcaaaattcattttcagattctgaatttattttccattgaatctatataaactataaagacagaagatatatgtatgtgtgtatacccacgtttctcttccagtgtcaactgataaaaatagatttcaaagtctcaataacctttaattccctttttctcttaaaaattctttagaacttgtacatgacattctgactctagcagattttagaaaacagagaggccattagatattcataccttactattcagatgaagtattcaatgctaaattatgtaatttatctgctttgcaaattgtatggtcagattgagttccacaaaggagagataatttttaatataggcattctgtagcttccctaattattgaattagtttagagcaaaatccttaaattgtatcgttgctatgctcaaattttgtatacttgtccacgtaggctatattaagatttcattgaattttggtttctttctcagtgataattcaatatatcaactcaccactcagatttgcctttgggaaaatccaggccccttttctggatttttagagcagattttaaaaaagtgattctgtatatgtgttgaaattaaccacatctcattgcttttgaatgattgaggtaatgtatacctactactttaaaaaaaatgacttacttagaaggtgtccatagttttataagttccattgaactggtttatattgtatttagaaaggaaaactactccttttatccttaagggtgaaaacctggattttattatacaattaacacatatttattttttattatgaaatatatcacaatataaacgtttacagggagtgtttaaagtggtgttgtccaatggaaatataatgtgagtcaaatacgtagttttcaattttctactagccatattagaaaaagaaacagagaaattaatgtaataggatactttatttagcctagtatatccaaatcacaattatttaaatatgtaatcaatataaaaattactaattatgtatttaacctttttctttagtaagtctctgaaatctagtgtatattttacatttatggcacattgcaatttgcattagtcacatttgaattgttcaatagccacaggtggctaatggctaccgtgttggacagcacaggtttaaagaataatatgaacatctgtgttccaacattctgagtttcaaataagaagaacaccatcagtattttgggagaagctccctatgttaccccttgctaatcaccttccttccccccagagccaaaagtaaccattatcttgaatttctagtaaacaatgctcattttttaaaaaacgtatgttcaacacctgtatttgtatctttaaagagtagctagttttagtttgcctggatttgaactttatattaagggaaccaccccatctctaatcttctctgtgaattcttttctctcaatactatgttttacatatttacgttcatcaatgtgcaactcattgtatgtatataacacaatgtatatattttacatgcgtatggacatttgggttgtttttatgtttttgttcatcacaaaccacaacacacatgtgttcttgtatatgttttatagtgcatgtttaaaaatttctcaacagtattcgctagtagtattgtcaggtcatagggtatgcacacataaatagaaatgattgattagctgcaatttgtagtgcacacatatttgctatgtaagtgatccatgtttaagactttaactgaatttaaaaaatattttattggagccaatctaaatgagctaagggtttgtattgtttacataagcaaagattacacttactgggtcaattcggttgattaactttggatatataaaatatatagctagttgttaaatagatataattattaattggcattacttttgtttgtatataaaaatttcaaaatatccatgacttaagcaaggtaaacacccactgggtggcttaagcaacagaaatgtatttcttgcagttccggaagttgaacgtctaagattaaggtgatgacagggttggtttctggtgagtcctcccccattggcttgcagatagccgccttctccttcatgacctttcctctgtgtatgtgcatcccttgtagctgttcttccttttatgaggacattagacttattggattaaggtcctacccatatgaactcatttaaccttaattacccctttaaaggccctacctccacttgcaggggttaaaacttcaacatatgaatggggttgaggagacctacttcagtccataacagtttctatattctgaagatggtctttaattaactaaacagttaatgttactttactgggaatgtcttttggatgggggaataagctgatgatatgagaagggttggtgaatttctcataagtgtgaaatttgttgggccggcccagcatgattttcaatcaaatacgctttggggacaagtaggttgaatcactacgagaggtttaaaagaaagcaagttgtaattgcaacttttaattgaaagaaagacaggctttgttgatgtgccagcaagactgataactggctttaacgtagatagtaaggcagcagattcaatccactgatcgtgatctactagtgaatttcaaagccttatgcaatagaactacaaaccctttccttgcccaccttgcaggtggatccataggcaaaatgaacatttgcaaaaaagccgctatgtttcagaatttgtgctagggctttaatatctataatttctccaaatcctcacaatttaagaattaattcaacttagccccatgaatagggtgaaaattctgagatttaacaaactaaaataagttatctgaagacagacaaatagaaagagttgagatattctatttgaatgtaaaattttcaaaaagtagaatgacagcgtcaggaattacagtctcagtgttgaacacaagacttaggaacaaatttgctgcatgtaatttcattgagatgggacaaagtacagcatacgtaaggaagttttagaacaaataagataattattttacgagctttgaaacatgtgtaagaaagatacgaataaaagtataatcacatttgactaaaacatgaataccttaaaactgaaaagcactgagattatcattatataattttgaatattttaaaccacaatgctttgggagtgcactgtaatattttagaattggaattttaacttactggcttaaaaagtaatgtactttgttttaaattcaaagattatcttgtaaattcagttcgatctattgaaaaaattataaaattcggcaagaagccaaagaagaacaattatgtagctcaagataattaaattttcatgtttggctttagaaatatattcgtcgtgacatagtacatggtaatctagtgagcccagacaagtagttttctctttttgtcaaagggaacaatttgatgcgtgttcaagttgcttaaataaaattttgtatgtgctttctcatcacaagagaacaatatgatttttgaaattatttttactttataaaagaaaaaaaaaagccctcacagagaaaaaagaaaaaaatgatgatgtctttgaaaaacaaagttaatacagctttacatatatttgacctacatcagggttaatatttttcaaggtgaaacattagatgctggaacttgcaaaaacaggcaatcctcctttagatgaaacggacactctaagggttaattcattcactgagacctattgtgaagtaagccctacagagactgaaaaagttaaatgcaactcacaaaagttgctagaagagtcatgatgttaaaataaaataagtacacaatgtatgctgcaagtatacttagagccatgctaggtgcggttgagaagttcaatacaggtccaagataatagctgcttctcctatagaacatgtcttctcattggagggataagacctgtgtctatgaaacaggcgtaattacatagctctggaactatatatgccgaaataaatgagacagtaagtgttattgtactataaagaatgaagaaatcatgatgagaagtaacagttaatgaatgttttctagaaagagtaggatctgaattggccttaggttgtaagcagagtttatagatagagtagtggtatgtcagagtcactctgggtgcttaaacatacaaatccccaagtctcacccaaatgtgtcttcagatgaaaggaaaaaacaaatgacttgagctcccccgcaaagaacacgggtggtatattgagcagccaaggagtgaccagagtggcaggcccatgttgagggacaaaagaggacaattagaatatgattaatacaaatttacagtgggatgagttgttagcctgaggagcttgaatgtgaacctctgtgcaaaaaggagtcattaaatacttttgaaaaaggtgggatgggaagaaaatgacattctcaagacaattagatcgaacagtattaagcatgctgacttattaagttatgcaccttgagagggtggaatgagggaaaagggtctttatctggagtaagacaggaagaagctaagctgtaattcttactggactgtaaattatgtgcagatatattatctgtcatgttcgtgggcgcattctcagtacatagcacttgaaacaggtactcgataaattgtcaaatggatgcatggagtgatttccatgcaaaatctaatattgtatagtattagaagggggaaaaaagcatggcattatgctagcagaaatgtcatttggtattgaggatgaaacattttcaacagtttgcaaagccatccactcaaacattctgtcactttccaataattttgaaggatgttctttctacttctaccttattacacaatgagttgagtaagataaagaagtcatgtgcaacaaaacagagggagattttctgaaaggcactacaccaggaagttgttgtactcttgcttcatcttgccatcttggatatacttctggcgctacctccaggccagttcctcgttacatatgtcatttacttcccacatgctagactcaccgagttaatcattttgctgcagttaacacattttagcagagtgtaggtttatgggtgagaaggaaatcaatgatgtttcaatacagggttcttttcccatcccccttatttccacttagaactgtctctcaagtcttaatttgcctctaaacttttttcccagcttacattcttttctgaaaaatgcaacgacgatgccaatgtttgttgacctgaaatacattgtaaaacattcataatactttgagcagagcttccaaactcccatttgcctcttttatctcccttaccttggcccctttttgaaggcaatgtgatatttaatccgtttctattgatgcttcaaaattattgaaaaactggtaattgtatttttccctttacttatcagttgctagttgacaatgagtgtttgcccaaacaataaccaatcaaaaggtaaaaaggagattccagacatatctgagaagaaattctttggaagaagcccgtaaatggaatgggaattcaaacaaagccgtttccaaaagaaatactaaatggtctctaaatgcaaaaggattgctccccaagcattttatgggagcataaaaagctcccaacacattttatgacaatacttctactcaatgacttcttgtgttgacatatttgttgcactcgacgttagtatttacagcttcttatcccaaatatttacttaactgaagccctgatgtttttaaaaacttttcatctgtgtttaacagcccattttacagaaacttatttgtttcatcaggcagatatttactgagaacttgcaagtgccatatattctaaaaatgctgatgataaaactgtgaacacaatagattctcatggtgcttatggtcagggctagcacacacacttgtgaaatgatcactgatgatcaaaggcataaacactacatttggaagaaataccgagggatccagaagtatcttggaaacactagcaagtatagcagatggtgggattggtgcttcaaagaacttcttgtggaagatgttacgtatgtaccttctctgtgccaggcactgctaggaagtgctggagagaaaaagatgtgctagataccgcctctgtcctatgtgcttgtgctttgtggggaggtgagtaggataatcccagttctcatgcagtgtaatgagtaccatgacggaaatgcactccaagaactaggcagcatgaccagagataggacatttgagaaagacttcactcgggtggtactatcttagtctgggtgctaaaatagatgtgatagatgagtaagggtgacccggaagcaggagggaaagggaggggctttcagaacaacaagtgcgaggacattaaggtgaaatagagtataatagtattcccagatccttgggattgttctccattaggctaaaacaaaggtgttttctcttctttaagatttcatgactgcagattgcataacagaaggtcatttaatagacctctaaactgaaggaattcttgaattaaatcacaacatatcttccatggccagagaaaccattgcctccttatgtcgacattactaacagcaccagcacctgctgctcaggccagcgggagggttgggtgttgctgcctaggtaatgctcaccaactgatgtcctgccatgagtagttttgccaagttccacaaaaaaaacttagtgttctatcagcatctaatgagaattacagtcattagttaaataaaagaactattagataaggagcagaatgaacaacacacaatccatcagcttggtgaatggtatcagatggtttctgggtgctgggcagctgtgcatccaagtagacagggagaatatatatgtcctttgccttatgtacttgtttctctaatccaaaggcacagcaatccgtggaagctgctatgataaggtgtttagtggtgaaaatgtcttgaaagccagtagattattaaagtgatgtttttaaaaatgcagatggagagtaagtactttttatctagagtagtagttctcaaagggaggtcccgggatcagcagcgttagcatcacttgggaacttagacctgcatgggccccattccagatctcacttgaaaactctagggggtgtagcccggcagtctttgttgtgaccagctctccagggggttctgacactccaaatgttcaagtttcagaacgctactcacaggccatcatgctcggcatcacctgaaagcttgttagaactagaaagtcttggccccaccccaagcctactaaatcagagtttttgggagtagggccaagaaaactgtgggttaacaaggtctccaagtgattcttattcatgtcaaaatttgaaaagcgtcgatcgaactgttggttctcagctttgattgcgtatctgaatcacctggggagacagttgagctattccgggcccagatcacatctagaccaattgaatcagaatctatggaggcaggacccagacatcagtattttaaaatatttcttgaatgatcccagagtgtagctaaggttgagaaacactgttctaggattaaaggattaatgtgtttgagagtatgttaagatcttaggcaaatcacaagggtgttaagaactaccatcttcgcaaaaggagaatgtgcctcagatattctggtactgctttgattttaccttcagtagtcttacctattttgagtatgcttagtagtactaatatgaggcttattactaatatgttaaaatttgtcttttaattaagtgggtctaaacgttttaatctttaatctctgacccaactagaacttttctaaacattttcataatagtctccaccttgtcttctgaccttcacttatgttctttcagggttcttcgtgtgttactagtaatagtaatggcaagtgtttattgaacacttactatgtgaagattctaactggcttttaataatcacatcagctctgggaggtagaaggtagggatcctccttgcttatcaggtgagaaaactgtactatagagaagttagcaacttttcccaggtcataatatgtgacagctaaagggagcataatggttggaataaaataaatctactctagttgtaccgaaggctcatatttgtctcacgtacttgatttggtcgaggcccaaggggtcaatttccaatgcttggattcctggatatgtagagttgtattaaaaatgctaaaaacctattatgtatcatacaatcatacatatcacctaaagtattatggaaatgaatctgtattattaagggaaaaaggcctgtgtgaagaacaactgaaacttcattttaattgaaattaaataacatgcatcatacactaaaagtgcacgttatgaccccatgaattacttcaggtggctttgattcatgttacatacactaacaaatatagaagagtgatataatgcttcttaattaactactaatggaagtttactatttaactgcttcttatgtaagaatgtaaatgttttctgaaatatcagaacttttcattaggaagcacttttaaaaatagcaaaactgatatgcactatgatttccatatacattaaattgaacttgtaaatgatgttataaattatagaaaccaaggggatgttcaaattagatatttgtctaaataaatcatgtatggattgaacaaatactcattgagaaataaatgtattccttttctttcaattatctaggattccttgtttatctcttcagaagcaaaatgtcttctgtccgttttatttccagttaaacattcttcagattatgtaaataagttaacttccaatcctcttatttctgtttatctcaccactcttctaatttagacgtgatcaatatcttatctttttgcatttcatagacatcaggatccagaataattgagtgagctcaaaacaacaatggcaagaatgatgttttcagaaaactcagcaatcattcgtttaataaatattcattgcctaccaactataagcaaagtattggctaggccatgtggggtatacaaaaatgtattaaatatggctcattctccctaagaacttacacctattagacaaagtacatgcataaaaattataatgtataatagaaaataaatacaagccctagaatgcacagttgaagtacgatttgcatttattataaaaagaaagatgaattggctgggcacggtggctcacgcctgtaatcccagcactttgggaggccaaggtgggcagatcacgaggtcaggagttcgagaccatcctggccaacatggtgaaactctatctctactaaatatacaaaaattagccgggtttggtggtatgcacctgtaatcccagctacttagcaggctgaggcaggagaattgtttgaacctgggaggtggaggttgcagtgagccaagatctggccattgcactccagcctgggcaacagcaagattccatctcaaaaaaaaaaaaaggaaagaaaagaaaagattaatttcctgttagctaaatcaaggaaggcttcatggagaaaaaaatatttcaacacacacttgacgtagcagtgggatcaggctgatgttagggaagaatgaatgacattctacactgagaaagagatattcagtatatatatgaagagcagtagagaaactaacaagtggaaatagactcaatttacaatacttgcctgcctggagtactctatacgttgactgtaagttgcagtttactcagaacaatcccactttctacttgtttatcctatgtaatcatttattgggcctccttttgctctcaaaaatatccttgtttggataatagattatcactctgttcctaaatgaactgccctgtgtcctatcccagtaaaagggtgcattcgggcccttcgtaactgcctccactacatggttgattgaaaccagagcttggcattaagaagttagctgaacaatcagatttctattcttggaaaacccaagaatttcagaatagatacagaagctgtatagctttaataacatgacagagttgtagccttgaaagctatgtacaattcagaattatgagggagaagaaattgaagaaacagtagcagccgggtaaatgcagaaacaaatgagggagacacctagggggtgactgaggcacaataatggaagagaagtgcagtgaaattgcttgaactcttactgatgagatttctactgttgccttgaatccaggaccacctatatgttcattctttgtcatgctcagagttatgacagatgctgttattgaattccccagagactcccttatcgtctcacctcaaaccttacaataatcccttctatctttctatccatccaagctggcttaagtaaagtctatgatccatattcctagtaaacagagaagggaaagagactgaaggcaaaggccccaattagtaggctattgcaatatttcagggaaaaggcaatggccatcacattgttgtcccaggaatgagaatagaaatgaaagaagataatgaaagttgaaaggactgggggggcttgacaactgtttagacttgaggagtcagataaaataggaagccaaagataattcagaatattttgattttgattttcatcaccaaataagatagtagtactatgaagaaaaaatggttaaaaaacaataataataaagagaactcctccaaatagtaccaagggagggagtttaatagaggaaattaattccgtaggtgatgagagtcctgagaagccaaacgagaaaagatcaaaacaacccagggattggcagtcgcaggaagctgttctcacttatggctggggctttaagcacaaggtgacatgagatttcagaatttgaagtcgtctggaggcagctaggatcaggtggggcctgtcctgttcggcaggacctgcaaccacaggaggaggatgcgtcaagcagaaagttggaacacaagaggggattcagccataagccacaaaataccttccagagcagagagaaggagaaataccctgaattccgtattttccctgccatttagttccctgctattgccacacattgacgtattccatccagagaagtccattggcatatgagtctgggaaatgtagttcccagggggacatgatcttaagggaaatagacaatgactggtgcaacaactgacctgtgtgaggcaggagggaaaaaacaggaataatatagtttttctctagatcccttcatgcacaaagatgcaaaagaaatgtgttggcttaatgagccattctgggtggccctgtaggtggctgtcctacgaataagatttttagacaaaacagagatgacttcaaatgtcacaagaaaagtatcagacaggaattaatattgacttgatctgtcacaggcgtcaatgatttgcattaagccaacgatcttcattgttaatgtctgggaaattgccagcagcattacgactacttgtgtggattagtgtaacggattcccccactaacattcaggaaatcatgtcaagcacagagtgcctatgtaagagtggttgtgtctattcactacatttcttggactaataacacacttagccttcctgaattgccaacatgtacaaaaccagattggggttttttagttgttcatggaactatcatttattgggtagctcctgtagaagcaagatacagaaactctaattaggaataagacagtccctgtacttcaaagagctctcaggggaggcacacaagtaaacaagcaattattatcatacgttaggataataccgtcatggtgataaccactgagtgatagccaaacacatggaagaggtacccaagtctaacttggggtagtcagagactgctttcaaggatatccgagtaagtgttagctaagacatgatacgtatttctaggagggaaattttcaaggcaaggtggagattgtgcagtgacgcccagagcctggattattttggtgactgctagtatttcagaatgacttcagcaaaagttgtagagaagatagaagacaacaaagtataagcagaggccagataatgaggacctggaacagtggtttgctggtaaatgtttaacaagaggctcttggcggggagagagagtgtctgatttgcagcatttggcaaattttgttgcacaaatgctccagcatagccaatttcaagctaccagtgtgacgtcattgaatgcagaattggaaagaaacgggcagtagcacagcattgtatagttattttcattacccagatataatagataaaatatccagatggtatttaatagatatggatgcaaaatttaaatatatgtacattcatgtgcttcatgttactgaatgcgcacaacattcattatccattcattcacgtgttaatttaacaaacatttctgagcctctgctctgtgccaaacgcagttctagctgctggaattacagcactgaaaaaaaaaatttgtcctcactgaggtaagacaaacattattatgcccattttacagctgagaaattaagacatatgaggattaagcagtatagttaaaatcacacaattggtacatgaaggaatcaaagaggaaatcagctctcagattttaaatccagggactcgtttctgctataccatactacctacctagttgagctggattttatcatggtttccctatttttatcaccatgtggttggataagtaaaataaatatatgtgacctttcaaataaatttgggtcatttttcttggaagctcatctggtgtgaactttaaaatactgcaattaataatgattataataccctggaactctgtagcaacctcttttgaagaactccaaggagcctctaaatgtatcaaactaagttcttcaagtgaattagttatcatctgagagtaatatagacttttaaaaatgcattaattgtattaaccctttcaggcccatagacttaagtgtttctttctccaaataaaaatagtaatctctgtccattttctttagagaataatgaagtaattttcattgaatatgtagtcaacataattacttcaattcaatcgtgaaggattttaaaaattatttatgtctactaacttaaagacatgcatagatttcaagaacttaaaaatgcatattgcctctttgccctatgcctcataaaacaaaattatgataacgttgtgtgttacagaaaaacgcactgattgtaatgaagggtgcttcaaaggccatgaacttggaaagcaacttatttacagagacccccagcaatagcagctaaaagattgactgactccctttattttcagttatccttcagacacttttgacctcttcctgtgcctttctagtcatgtgcaatcttgtggatatctcttccttcctcttgttattttctatttcctctgtttctatttgtttctaaaaataatcatgtttgaatataggattagcttccttcccatctccccattaccaatctctcactataccgctatgttattaatcttcctgagaaatatatcaggttcattacattagttaccagctcaaaacgtatcagtggctttctagtcctcacaggctcaagttaatctgcatattctgactttcatattctgggttcatgcaaacttttcaactttccctcttatacctacttaggaggaccctcaggttccatcatgctcatgtttcaagccagaagttctcctgcctcttcctctatgtagactccacatagactatgatatcctgcttctcttttaatcctccatcttcagctcacagccacactcctctgtgaacagttaaatgattctcccacctcttacctcctatagcacttatttttcatgcagcatttttgagacttaattaaatctacagttttaaaaaatgtttttctaccacagtctcttattcatactaaaactttcaagtctatccattttgcttatacaaccacaccgttaggtcttttaggtccaagaatacaagagaatggcaaagcacgttgtttacatccacacatactgtgtaaattcaggtaattttttttaatcctatgatcctcaattacctcacctgtaaaataggtactactcatactgcagaactcttgttggaattaaataaatgagtgtattaaaaatgctcaacaagatttggcacaaaatcggtactcagtaaatgctaatcattattccctttctcttcaaagctccacaattctgtattcatatcaccctctttatatcatttgcaaaaatgtatcctattccaactctttccacctagcctcaacatttacaaacactcctggtgggaagggaaagcttttgaggagagcacatctatactcatttacttctcagggatgcaagctgccctgcttactgagggcatatgttcatagtcacaccggagcccactgtccccttatactctcaaatgggcagtagcaaatcatcttgatcggtagtaatgacctgtctctaaattttcacatgcatcagataatttcttttttagtaagtgttatcttacatatatgccaaaatatcaccattatatggaacactagctgaaagaaaaattattcagtagtcttaattttctagctaacataaattctctccattttcatcatccatttagattaaagactttactgttagctgaatattcagagactttattctgatttttaaaatttatgaggttcataatgttaagacttcaagggtgagctgtttgtgtcatttataatgcgtgactagacagtaactagaaaatggattgttgactttacaagatttctccccaccacgtccccccaaacctgtgctgctgtgtatttggcctgaaatctttacttctagtcaatctttggacctaaagcctaccagcttttagcatcctttaagattgacgtgtctctgggagaccaatagatgctaaaccaaatttcgtatgcacttggcaatataggataataacaaccatactccctgcaattgtttcctaacacagatgtaacaaattaccacaagctgggtggcttaatagacatttattctctcacaaatctggaagctaggtgtccaaaatcaaggtcaattatccctctgaaggctctggggaagaattcttccttgcctcttccagcttctggtagccccaggtgttccttgatttcaagcagcacaagttcaacatctgctcctgacctcacataaccctcttctttgtgtgtctttctgtgtccactcttttctttattattattattattattattattattattattatactttaagttttagggtacatgtgcacaatgtgcaggttagttacatatgtatgcatgtgccatgctggtgtgctgcacccattagctcatcatttagcattaggtatatctcctaatgctatccctccccccctccccccaccccacaacagtccccagagtgtgatgttcccattcctgtgtccatgtgttctcattgttcaattcccacctgtgagtgagagtatgcagtgtttggttttttgttcttgcgatagtttactgagaatgatgatttccaatttcatccatgtctctacaaagaacatgaactcatcatttttttatggctgcatagtattccatggtgtatatgtgccacattttcttaatccagtctatcattgttggacatttgggttggttccaagtctttgctattgtgaatagtgccgcaaaaggacaccagtctttggatttagagcccaccctaaattcatggtgatgtcattttgaaattcttaactaattacatcttcaaagaccctatttccaaatctggtgacattcaaggtttcagggacatgtgactattcaggggaaactattcatcccaccacatcccccttgaaaattctggaaaatgtagtaataaaggcttctgataaattagtgtggaaagtattcacggttataaattactaaaaagtctcactgtgagctcttaatcaaaaggccctataaaacatttatttgcttgattaaaactacacatccgatattttggttttggatttattattatttttagacttggaataactattttatgtgaaatagattccataactgaagcagcatacctctcaatttcccaacatttattttattattttttgtcttcacactacttaataactgaggaaaaatcatttagaccaaagttcaccttggttgacaccatccagacagctacaggaaataacaatggaaactaaatctctaagaaaaagagtctttcatgtgaaatattgcagagttgattctagatatatagctgttggaagaatggatactattacatagatatggcagagtggtatccagcacctttcaacaaagatctttcagagtcagtcttattatgtctggagaatttacccagggcttaggtgcttttactgacaatctaaccacctgcaccccacccaccgtctaaagctaaagtttattggaagacttaggaaatcagtcttcggaatgtttctgagactggtacacccaccacttcattaaagtgcttcacttcacttcattagacaagaagtaaaatacttgtcaggaaattatttatagtaccatgtatatgggtatcttatttaatactacttaatgatggtactacaagttatataaaatggagaaataagtcatcaagtttgacaataatgatatttgatattatcattatcttttttattcgttcccacagaagtactctgttattggtttagaaaaatgatatttgatataataaagaaggaaaaggtggtaatattctttattttttgtatctttataccccagctctttcaccaatctcccccatctctgtagttctcctctggtgtccccaggcagtgaactattcccagtggttagggaacatctcattgagtaagttacatcaacatttcttcacatttcaggacaacaggaacagtgccaaatcctagcccattgttcaactctcaagccttattatcctaataacacatccatcccaagaaagaattcatcaagatcagagaggaatacgtataattttttatagtacagtatttaaaatgaaacagcttttggcccgcgtggtctcagtgggctcaagggggaaattcaggatgctagctcatctcacaccaagtttaataaagggtgtcctataaaaagctaatttcttgctggtaaattgctttttaagtaatccttgctgttgcaagagacccattcatagcgctgacactgggagccatgttggaaaggctagatatgctctgggagataaggtaagatccaggtggaatcttctctttacagaatgacaatgtatatagctaatattgtcctttgaggctagtttgcatgcagttgctggtatggcactgctcagcagcctgctgcagataagaatgagtgatgatgccctagattttaatggaacttttagagtgcatgcagcagtggggtgcagtcttcagcaaagaaaaacgagctgacttgcaggcatgagagatcatcaagaaagataaagaaataggacatccactctaggttaggcaaggctttttagaggatattatggaaatgagcaagaaccaatttaatttttataatgccactccatttaactttaaaatacaaggtcaaggtactgtgtttttcataatgattaaagatttggagcactctttctgttgaaacatactgcatctgtttggcagaaaaaaaaagtgacaaagaataaaactgggatcagagaacaacaaaaacatattctgtcacttgcctaacacaagttaaaaagcaaaggaaaaagagacaactctgatggacatgttcatccttatcccaacagaaggatttatttacctaaggtcctattatttcaagttactttgatcccaggatggtaacataaaatgtacattttaaaataaaatggaagtataagatcaataaaaaccacatatctgtggataaaacagcagattcaatcttgtggctgaaagtttgctttaacccaacatttggtaaactattcactctgtaatttattaaaagacatactgttattataaaactatctcagtttgcatcttgttggttctgtcaaaatttcatcctgctaattctcaacttgtaatatctctgatatacatgattaatctattttaggaataaaacaaaaactacctttatcttacgcatttctaggaagtgtttttagatgtaaagtaggggtaattgtagtatagtggaaaggattttgaacttgaagccagaacatatgtctctgccaaaaactaggtgtgtgaccttaaataagttacttagcttcctgaatcttagtttgtttagcttttttctataaagtggcacacctatccacatcacagttttgttgtcaaaattaaataaaatactatattagaaagaaacttttagaaagaaatttataaactgaaatgtactatacaagtttaaatcattctcattattttcttaccctaaaattttgaccttatttttcttagcaaatggctgaatctgtaaaatttaacccccacgcagcatctggattcaagagaactacggtcatttctttatacagaatactaattatacacatatagcaaaacacaagttttttccaactactctgtgtttttaaagattcagtgtgggcagaaggaattttatcaactatgttaggggaaaaaagtctgaagaaatgaaaataatgagaaaaagcactgttgatttaagtgcaggaacataaaacttcaaggcaaatgtgaggccaactgagttcatatatatcctcacaaaatgatttagttaatttaaaaacttttctaataagcaacacaggtaatcccaaattctatcttttatagctctaagagtccccataatttattcagcaattatttaccacccacttattataagaaaagccctgggataagtcttgagaagaaactaacaaaaacaaaacttgattgtttgctctcaaaaagctgggtctaaaataggcaaggtaagattttgttttgaggagcccgtattttccagcactgtccattgtaacattaaaatagtttgccaaaatcctcactctgtgggtgtatttgcctagggtgctaaaattgcttaaaaactttgttatttggctaactaaaatcactgaatagtaaacagtagcattagagatggcagagacattaggtgtcatgcagttcaactgcttcacctagcagacaaagacattaagttccatttcttaaatttaactatctggttgaggatacacagtagcagagctaaatcaagaacctcttggggttagagtttttgtttatgcattactttgttttggaattaaaaacagtgcctgtttgctaagttaaattgaaaatatgctctgaaggagaaaaacagctataaaaatagacttaacttccaaactatggatcacaataaactaaagaaataatttctgtagcaataaactccaacactttccataggaccagaaaggcttgagaaagaggagaacaaaaaaatgctttggggcttaccatatatatggagaaagctaaatgaataaaccagttgaaagacagcgagttatactagtaacaatattactgatatcggagctctcacttataaattgtatattatgatcatagtgactaggtactttatatctgctttctcattccttcctcacattaattcacatgtaggacagattacctcttctgtttctatccagaggcctagagctcaggccctcatcgaagacagacagagctatcatccttattctaaaaaaaaactaagaccccagacatagctgtgctacttatagactagaatgtgagagaaaaagacaagctttcatcatgggcttaacaaactgaaacacttcttcaattttgagattgagaaacttagctaatgctaggtgtaaagatgatatgctaccttcataaccttggtgaggagaaattagcatttctctcagtcctagaaggaggatgaccatgaaggtcttcattctcttgagaagataatcaaatgcttcactgccctgttaacggtttactcaatattcaccaagaaaagtagatgggattatttttgcagacacttatacgggtaatttattctgataagcagagacatacctttagtgcataaattgttccctttgtgctctttgtaataaacatcaccatagagaacaaacacgaagtaatgacattgaattaaaagacaccatagaggcaacagcgactggaatttgtgaaagtaaaaggatagtgcaaacagttgtgcgttgcattctgctctgaagattaacaagctgggtcaggctttgaccatcatgatgagcaggagatttttctaatggaaatccccaatcaagttcctgctgcacccagaaaggaacggcttacagaaatcttacatttctttgcacataccaaattgcttggcatattctatcacaaggtttactttccagggaatgtgatcaagaaatcatgatcctaattcctagttaaccctcaaagtttctcagaacagtcagtgcatcactgtcaacttttgtgcaatgtggaaatcagaattggtcacacgtttttccggccactgttttagattcatataatattagtgaaatcatgtcagactggtatagccatgaatttatacttcatgaataggcactcaataaatagtggattaaatcgaccgatttgatttttacctccaataatttcaaaaatatcattgaagacaaggttgttgaagctgtcacttttcttgctgaacctttgttgtgccaggaggaacagatggtaaaatcaaaagtgattagagaatcagtggggtgggggtgagattggaggggagaggtcttcccagtgagacccgctagcgtcttccctgagcagtatgttaacccaagacaattttagaaatctgtgcccctaagttgcttgacatccaaagcacacttgatgcatcctacatttctaaatatttttattgttgtttctcggtagtaatcatctggtttagtcactctaaaagtcaaggatgaaattttaaaatgcaaataaaagtgcctactttctctctttccaattcctttttgttttattgaggtataatttacatgcacaaaaaaatcgcctttttaaagtgtacagtttgatgagttttgacaaacatatgcagtcctacaaccacgtccgtgatcagaataggaaatatttttatcacttcaaaaagtttccttgtactcccgttgcagtcagtctcctgccccaccccagcccctggaaaccactgataggtaaaagcacttttaatctgaaaggtatttaatgtatggcagtgtcagtggtaataataacaagatttattcattggttcactgtatttttgagcacttatatgtgcccgttgtatgcaacccattatgctcaacccctgccctcctcaccagggataaactagtggcagagatagacaaagaagccgtctctctatcacccctatcttatagaacattcttcaatgttagaaatgcagtataatgtggccattgagaacttgaaatgtgcttagtgggaatgaagaactgaagttttaactttatttaatttcaattaatttaaatttatatagccacatgtggctaatgactatcccactggaaagtacagcttctatacaatatgataatatgatacattataacgcaggagtttaaccaagtgctaaagctttactatcaccagggtcactggtgttatgtgaaaagaaaacttacaatagaaaaataaatcctttaaatagtcacagacctgagaaagtttccttctcaagggaacacacattggctcattcaaaggaggttaaaaactagcatttaaggtaatttcatgaagctttcctttggatttctcatgcttattgtatacataaataggcaattttcgatgggacctaataaatcactgttttttatttgaacattttaacaaaattatcaaacagcattgcatttatgttcaacctatttgttctgagaaagacaacgattaagtagaagtcatcaaagttaccagaacaatttttgttcttatgttttagaaggcattgaaggtgtttaaaatgtacacttatagagtcagagtactatgcaactgtggcccttatagtttatccgtcatgcatctaaagccattgttacatctgtttctaattgtgcatggattgtccaagatacacaattggaaattccattttatttatcaatttgaagaggtttcacccatgtggtcactatgatcactatggagtcacattaaattgagaagtctccagaagttgcagtatttatttaaaattctaactttcttcagaggaacaaattctccatttctggattctgaatcctcattagccataaggttgttgtaagaatttgcagctaataggaacacatcctggggagagaccagttgaaaagtaacttggttctgagtgaaattatacagagacagtttctacttcaggtggtgttgctaatgaagctatcatggtaattttagcccatatgatccctaaacgacttcagaaccacttttcatccactaagaacccacttcaaccactgccacgttcactaccacagtataatatggaacaccctctggaattcagtaagtaacttcttaactcattggctatagagctttgcctttgtaaattctttccttttgcagtaaaagagattgtttcaaagtaatccaattagtccctaggcatgtctagaaaggtagagtcaacaacagtaaggtaatagtccttataagatatgtaagaaattatcagtcatttactttaaaataatttgtacacttttccttttatatggttcttctatgttgaagccagtggtcatccagtgattaagattagccaaactcaaaaggctaaaactaaattcaaatggtattattttgctttaattttatgcaatgctatgtatttaaatttcatgaaagtttcgtatggcattgctatcaatttcagtcaggataaatttcccgtgaaataatccacaattttcaactgtacgttgggtacaggtaaggaaacacccttaagagcttatccagttattagctggtattataaatttcaagtaattcaatgttcaattaataaacagttactttaaatgggaaagtatgagtcaagagttagtacaaaggagaatcttaaaagatgaacatcaaagaatcttactattgatttgttggtgcctttgcttgcacttctccaaattgacttgacgttttaaatttgtactgataatcatcagagtcaaatctgcttttaggcaaaaagtatccgctagttattcccctactatgaaagtgatgagatgaattgatcatgtctccagtgtatggatggatgtctttgaggaagacctactgaccttatgtttatcttctgtcagcatggtgtgactatgtggagagacagtgctatttgctaaatactttgtttttcaaataaaaagatttcacagattatgcattgtagaatttataagtattcttttatgtctttgaatgtgccaatacaatttttatgaagttggaactattttatctattttaatgaaattgtaagccttctgtgaattcttttattaattttattctgaagaaaatctgaccaggttagggaaatcaggtcaggttacgacgtgatcccagtggaaaagctgaactgtggactgtgatttaaaatagggaagaggtactgaagtgttgtttttatttttgtttacaaatcagcctttctaactattatgtactcccatccttctatctttttctccaccagaacgtattaacaggcatgcatataattaatgcttttcttgagataatattaaaattaacttcatctgtcaggccgtctgggctaaaagtacacagtcagatctgggtaacatttgagttgatgtaaatatgcccacacatactgacaatgcttaccatttattgtgtgaatgaaaagcagtgtaaatattgtttgttctactagggaagctccacattttaatcaaactttgaccgtatttctaaaatgccagagcatctggaattgttaaaggaactgatagtttttgtgtttttaactgttaggatacttgaaatccaaagggtaaagaaactcagctgatttatacgtttcttcctctttattttaatgtgataaaatgtagtttttgtcatgggctgacaaacagtggtagactacactaactctgcgtttgctgggtttaatcttaccctctcaaggcatggaatgggagctcacttcagacccagccatgcttcactgtccactgccttctcatggatatagtgtgaacattaattagatgaattccataaagtgctttaagctctttggagaaagatactcgctgcataattattcttaactcccatacgctcttatgatataaaccattctgccaggaaatcctttttagggattatcacttaaaatgaaattttcattattaaaagcaggaagaatatacatctactgacagacgaaaatgtgcttaaggcgactgcttttaaataggcagaaatcctgaactatggagccatccatgcctgaaaatactgagtaataatgaaaactggtagcaaatttggaatattaatcatcacattaagttgcaaagaaaaaaaaatacaagccacatgccctttaaaaatacgtgcacaaatctttattctagaaatatataactttaggcctaaaaaagtacaaaaagtaaattattttatggctctgaaagtatccttaatttactcaggtgacaacaattagtgtttaaagagttagttttcaatcttagctacaagttggaattactctggaagctctaaaaaaacaaaaaacaaaaaaaaatagagatgcctagttcccacctgcagaaattctgatttgatttttctggtgcgagacctgagaataggaatttttttaaagcttccctagtgattctagtgtgccacctaggttgccttaaggtaaacctcatattatgcagaacctagcaatcacctatcctgattttatagacgaagatcataagacccaagagggcaaattgatttattcaagattgaatatacaaatgatagaagattcacataagatgcagtatacagagtggcttgtggattcttgccaatgcaggcagcagaattttctttagggttcacccagttcaggcacctctttgcagcagcacttgactaaggttcttctgattggatcattatatgggcaaaaagaaaaagcttaattgaaaagagctgaacccacattgtggaatggaagatatacagtttacacgttataaatgattaatattcatgaaagcatactgccctttcctcttcccttcccatagatgacatcattgcattggtgtagttaggttggtggtttcttgttgttgatcttggttctgacacagttcatcacttattatcctggcttattatctacttctacattcattgttcactcactcactaattaattcaacatggtttttattgttttggaccggttatatgcctgcaacgctacgtaaggctgaggatattacaatgaacaggaaacaaccctgaagtttaaggtatcaagcctttgagttactgtcttttatcatagctgatataaaattgaagccccactttttttgttttcaattactgaaaattcagtgctaaaaaaatgtggatttttattcaactagataaagtactacaattaggtttccactgaccttggctgtttttgttcccagttgccattacataaatctgtgccactcacaacttaggaagggtgtaacattctctgtaatagtttgcctttcgaatagtgtttggattcattactgtccctcgcagtttggaataatgaccactgaataatcagtgtttggagactaaattagtgctgcaaaattccctcaaattacctactgttcttttccctgtcgatgtatcctcatattcactatgattaccctgagaagaaagatattgttgagaaccactttacctactcgaagttttggtatttcaaagattcatacttatgtcatgttgattacattagcactaatactattggcagaattctaattcacgttattttctttttttccaatttctctccatgcctatgtgttgtcccttcgcagctataaagccatggccgattcatgggtgcttttgttaaggcgttcagcagtcacgtttgtagatttttgaatgggacttagagcccttttttgttctttatgtatttctctatttctcagcaaaggaaatgcagacatgcaagaaatagtgatcaaatgtcctgtgtactattgtgggtgtcattaatggtatagggagaaatagaaaatagttgcaaagatgcatttaacaaataaacgaggtcttgagattcaccatgaatgtggccccttctatgaaaagtagttaacatccaactgcaaagttgtactggatcagtttgactttaacctttagctaatatgaaaatatggaattgtgtggtggtgctcacaaaaaagaaaactcatttttcttaattatcatcaattaacatgtactgactacccatgagggaaagttaatttgctcttgagtggaaccagttatttgccctattatttctcccttgcttattcccctctccctccctcctccctttccattcaacaaagaaaaatagataaagcaatttctgattagccagtgaaagcctctaacataaaatttccaaagatgtgccataaattatccacaaaatgtaaaacttttcaattttggtttgcattttcttttttcttattataaaggtaataagtgctcattatagaatttgaaaaatataggaagttgcacggaagacgaataaaatcagccataatcctacaaacctattgacacttgtacatatgtttgttatctctaatgcattcattatgataatgcatcttttcaaccaatagagtaatcactggtgactttcaaatttgcctactcatttttcactctgtggacttactttactacctcttgccctttttcagtaaatgaataaatatttaagtaagtaaatacaaatgtaataacttatgcgctcaagcacacagatacacacagagagaatttggaacttcggaaatgccatcctctccctagggccgcaagtgagttgataagcacgtaaggaaggataatcaggggagccttctcgtattgcccagatggctcaaaattcgtcatctctaccaaacaactatttggagctttgaagaaatatccatgacccctttgaattcttcagtttctttcgcgttcactttgagaaccaagtgacaagtgaatttcctgacttggtcttttaaacctgttagcgcagttccattgagattttgtgggcacaagattgcaatgaagagatcaacagggagaaattcatttccctatatatgtgcgattaatccggagtgctaagggcagatataaagcaggtgcctactcctgtataacttggaataaaaccatttccaaaggctgatgatcctcaagtcttgttctgcaaatgactgatgtataacttcaggccaatttttctccagttagtctgtgtcactgggagtcccatttctcggggagcagccccatgctttgtcaggtgcggagcccacagaaggttaatgcgaaaagaaggcctcttgccagactgttttccagatgatacgtagggttattagtttgagctccttaagaagatttttctcacctgtcctaccaacttatgtttatttcattggtgttagagggtttcagtggcggaagtaaaatatttagcggggaagggacagcgttcatgggaattttgcctaacttaattttgtatctttagctcattcgtagtcattgtactttgtgttttgtcaactgaattttgtttgcatacaaaggcacaaaatgtttgcttcagacctgtcactcttatttttagcatggttagacaaaaactgagatgctttaattgtctaacttatcccagtttaagtgctgcaaaatctcccaggcaatgtcatgggcaactaagggataaaatcagagatttaaaggtgccaggtttcccacgcttctaacagttggcgttttgggtgtatacaatccctcagctttcttctttagtttatggagtcttgtggagggaatagcaggtttttagctaaaattatcatgctgtcgagttgggtctctagtgcatcctgaagagcttgcattatttacagaggctgggctatcattttaaatcctgatgcttcaatgcccgttatcattcttgacaaactcttccagcccgtggtctgttttcctctgtttgcttccatttactttcctgagcaaccagctgagcaaagatttacataacttttgtttaaacaaaccctgtacagttcactctttcagccagtatgtaaacacttttgagacacagttacatttttctattttagtcccagattctgtttatttgctacattttttgtgcccacatttttgtctttgttaagtctcttacagattcacatgaaaaaccagaaaccgtggctgctcaaaagtcattaataatgagatttttagctactgtttctgcttgtaaattcttcatttcacataatacagtctcaaaaggccacagagaattcagcctcgcttatctctgtgttgcagatgatggcttctagccttacccaatcccagtgcagcttgcttgccatccaggagtcgaatttgtttccatctgacattagcgtattaaaaagattggagatcaacaagcaacaatgttcttgtagaaaggtaatcaaggtttagagcctgtgtgtcatgagactcctagcatttgaaaccgctaaggggttgaccaccattgtcccaagcacctgtttaagattctttcctatgataagggacctaaagtgattagcatactgataagattttcctagaataacctatttatttcagtattattctttcaaatcttaattaccatcttttcctttacccagggtcttctttctacctctacgacacatttaattacctatattccccaacctgtaccatattaaattttgaatggaagttttatagggtaatttattggaaggatggccttgagtgtcattatgttcaatgaatgccctattttgacaaagagatgactaaatgttattgaaatctttttaatccaccacgcttctgcttagatgtaaatgcaaatctgttctttacatttgtgattgaattgaacttgaaaagtaccgccatattgattccttctgcaaataaaatataattacatttccctaaactttctacactctcccaagagattggctggctttgtattgtagatttttggtgatcacagaggacaatgcattatcataagaccaataagatttatttttaccttggtaaagaattttaatttatttctagtttcattttcatttatatccatctcttctcaccctctgctctacaaaagtatatatgactatataaattgaaaaaaatatcaagtgcaaaattacagaaataaataattaggttattttagtggaggaaggtttgttgtgggtggaggaggagaggagtgagccaagaaaaacgagggaccatacgtgatcatatttttgcagctattttaaattgtttgtgtatatactttaaaatattataaaataaaattttaagtgcaatgcatatttggagccaatgatgagggataacttcagaaacgtagcatcatcatctagtgctttcatagtcctttcaacatttccagatagttttaatggcctgctcatggaggcaatgccctaattttaacatatctcttcacaactctgatttcttgcttcctaacattaaatgtcttcaaagcttctttcaccactaattccttatcaagaggataagccagtttattctttaagaaaaactagctacacaaaaccgtaagtcattccaacataaatccttcactatcctctctctatagatttggttttgattcctcctgctgaaattcaaccttctttcttcagctatccacacgtcttaccctctaacttccctcaggagtgtctattagctcccattacagtgaccacagtaatatagtaatcccctgctgttctcactctccacttccttacactgcgttttaagtctcttcatattctttatcaccttgtatcatgcatcggttttcttagttgtttattttatgttgccttcataaattccatgagagctcactgccgtatctttagaacatggaacagtgcttggaacataatgggcattccttaaatagctgtagaataaactttcaaaatcaacaataatgtatttgccaaatccattggcttctctgccattttatcttgttcaataccactgcgatattccccttcctttttttttttttttaaagtctgtaaccctttagcttctgtaatattcctagttttttattcctctcatgtgtcaaaatcatcagttgaggcttattgttttctctttctcactctgacctcacctttgtttacatctcatcttctggctttggctatcctgttttttatctctgttccaacctgtatttctagccctactacctggacatgacatgtggatatctccgtatgaccgcagtttccatatgactttgcaaattcatccctgctctcccctccaaagtcatccccacaattgacttcctgttccttccaacctattaaggttcaaacccacttttgctcctcctttgcaggctacacttttccttctcagtacctcttttttttccaagttcttagataaaagtcatagtaccttacgttgtaattgccactggtctggtctttctgcctgctttcctttccatttgtaatcacattatccattccaatccatttataatactgtgatcagccataaaaataacatttatcatatcgtttgtctccttaaaacctgtagtagatcccctctatttacaagatctggtataaaatcacccttcctgatattcaatgcctgttttaatataatctcaatattatgcgtcataaatccccctgtgttcttgcactttttatttcttatacatctcatcaaccatgtcttatcaactctcaaaacctgtattggttttcaggaaaactcataaattattcttttgtagaccttttgtttgtcatctttgaagatctctctctgaactacaatattttgtctgtataatcaatttggaaattcatcaggtattgaaatatgacatgtcttctattgtcttgaacattaattaaaactttatttgactttttatatgcttacatcttgtttcctcacggagtgttaacctactagaaagtaatagtttaatcttatatttattttaattcagatttagtagcatactttacacgtggtaggatgtgtaactgccttacaccttgcttacgtgagttattaatgttttcgtatatttaatctgaggatgtactagcaatgttaaaactgtaccgcatgaaattgagtaattgaactatttgttttaaatgtgttgcttaacttattgtaccattttctcataatcacagctcaagttaactttgtggttgtacgtattatttcttgtgaaatgccaacaaacttagagcaaggaaaataacaggtataatcatactataaaggcaaccttaacactagcatagtctcttagctcatatggtaactacaataatgtacagtgacaaagagaatattgtactttcttagcacacactttcctactactctactgttgtggataaaaacagacatactttaggagaaactatgttatttccaaataatgccttaaaggttactccaggaaaaggcatttacataaactatctaggaaaagaaccttttaaataatataaagagctcacccaaaaggactgaagtgtttagttgaaaaaaagtaaaaatgtcgaagactttgaaaaatagtttcttgcagtatattttcatcgcttccacttacgttatgaagacattaagcgctagtttatcaaaaactatttttgtacatgtcttctaatgacagaacaatgtcaacatgattttcatcattgagaatgcgtaaagaaaccctttgtacagttttttctatgaatgttcccctaagattaaagcaaatttccaacacgaattaggcactccgaaaggaggaggggagggaggggagcaagtgctgcaaaacttcctgttgggtactatgttcactatctgggtgatggaatcaacagaagcccaaacctcagcatcacgcagtatacccttgtaacaaaccaacacatgtacccctgagtctacattaaaaatagagattaaaaaaaggaaatcagtatataatctaataaatacctctcaagctttctcatttttaaaataaaattttagattattattttaggaataaaataggctcttcattgtatataagttcatttctgagttgcaaaaatcctctctttatgtttttttccccgtattagcatgtttttctcctgtttttccccactcaacttggctgccacaatcagaaagcacaaagacaattttttcttgcgcttgtaaatcaaaaccttagcatcagacaaaataactgctccaggtctgtcaaatagattcatttgagctttcttcatgcattgaatacggcagaatttctgacctgaagaaatctagccttttccaaatttgctttaagaacattttgcaataaatttaatataataaaaggaaaaaacacatcaggctagaatttggaaccgattgttattaaaaatctcaagtctatcaatttaacttcaacaaattacttaatttctgtgatggttaatttcatgtgtcaacttggctgggccgcagggtaccgagacatttggtcaaacattattctgggtgtgtttatgaggctgtttctggagagattcacatttgaatcagtagagggagcaaagccgattgttctcccttgtgtgggtgggtctgatccaatcaattgaggacctaagtccaatcgattgaagacctaatcaaaaagcctgattaaaaggaactcctgcctgatagctaaagctggaacacccatcttttcctgcctttgagcttgaattgaaaccttgggtcttcttgagtcttaagcctccagttctggggctggaacttaacgtcattggctttcttggttctcatgcctttggactcagacaggaactacatcattggctttcctgggtctccagcttgctgactgtaaatcttgggacttctccagattcgtaatgagccaatttattacaataagtctctccctctctggtttcgagagagagagagagagagacagagagagaaatgagagcacaagaacgtgagtgtgagagtgccctaatataatttctctaaatatcactggttactcttcaaagttataaaattggtataaaaggtgacctcaatttttcatggagttaatgtatgaaagtcacaattaaaaaggaagaattagttctggtgtcctgaaagttatttgaataaattaatatgctatggaggctttaaaatactatgaaaatttaatattgtattattcttagtgttgctatttttaaatagcactttttcttttcctttttttttttttttttttttttttttgagatggagtctcactctgttgcccaggctggagtgcagtggcatgatctcggctcactgcaagctccactgcccgggttcacgccattctcctgcctcagcctcccaagtagctgggactacaggcggccgccaccacgtccgggtaattttttgtatttttttagtagagacggagtttcaccgtgttagccaggttgttctcgatctcctgacctcatgatccacccaccttggcctcccaaagtgctgggattacaggcatgagccaccatgcccggcttaaatagcactttttcttgtgagtcactttttaaatatttgtgcaaaccttgttgccattctactcaagctaatatcctaaaccgaggacattataacatttcaggagtcaaaacttcagacacttaacatagtatcctcaggttcatccatgttgtcataaatgacaggattttattcttttatatgactcaataatatcccattgcatatatatgcaatattttctttattcatccattattaaacacttaagttgattctatatcttggctattgtgaataatgctgcaataaacatgggaatgcagatatctctatgacatactgattttatttgctttgtctctgtccccagtagtggaattgctgtatcgtatggtagttctatttttaagttttcgaggaacctccataccgtcctccataatggatgtactcatttacattcccaccaacagtgcataagggttcccttttctccatattcttgccaacactttttatcttttgtattttgataatagccattctaactggaatgagatgatatctcattgtggttttgatttgcattttcctgatagtgatgttgaacattttttcatatgttgtattaactaagccaaacacagaaagacaaatgcagcttgttctcattcatatgcacaatctaaaaacatcgatctcatagaagcagtaaatggacggtggtcaccaaagaatgggggaagtaggggaaaagcgagaatggggagaggattgtcaatgggtacaaagtcacgattagaaaggaagaattagttctggtgtcctgttgcatagtatggagactattgtcaacagtaaggtattgcgtatctcaaaacggctagaagagagggttttgaaggtttctaccccaaataaatggtaaatgtttgaggtgatatgctaattttcttgatttgatcaagtaaaggtcttaattgtttggcaattaagactcatgaatacaaataaaggtcttaattatttggcaaagcatgctgagttttgtaaacaattcagtagtgatttttgagaataggtcaatagcaaatattaattaaaatgtcttctatttatgacctacagctagatggtaaacagatagatgatagatagataactgatagataactaatagatgacagataaatgataaatagataaatatagataatcgagagagaatacctttcccttcacacacgtgcatataggcacactccatttctatcatagttaccaggattcagacattttgtctcactatttttctcaatgtgaacatgcatataggaatattatagtttttgttctgtgcccattttagttcgttttttaatatttcaggacaaaggcaatatggcggtttcactttgtttttcatttttgcttatactttttaaagctcagtgtagaaaagtttgaaaatacacaaaagtattaaattaagacagctgggcacagtggctcacgcctgtaatcccagcacttcgggaggccaaggtgggtggatcacgaggtcaagagatcgacaccatcctggccaacatggtgaatcccgtctctactaaaaatacaaaaattagctgagcatggtggtgtgtgcctgtagtcccagctactcgggaggctgaggcaggagaatcgcttgaacccgggaggcagaggttgcagtgagccgggatcacaccactgtattccagcctggtgacagagcgagactctgtctcagaaaaaaaacaaaacaaacaaacaaaaaagcacctatagtctttctcccataggttgccttcttaatgggttttacaccttttgatgttttcttgagttctgtcccattagcaagtagtattgtacaaaaaaaattttatcatcttttatttaatattttattgatgtttaataattagaattattttaaattttatatgtcattttaaaatgcaatacaatatagtaaactcccagatgtgattgtaaataattaattattctcccattattgggcattgggactgcttccacattttggtcactgcagtgaacatccttgtacatgaatctgtatgttgaagttgatttcattccacactccccttcattcaaggggctccaaccattctcgttttctttcagcttctttatatccaggcatataaagttccttcctgactcgggagcgtcatacatgctgttttctccatctggataagtagttaattctgttcttctttgtgcatctcccgtttcagtaacttcatctccaaagcctttccaggtcactttatctaaagttacaccataatcttgcaaatcctcaactattgagcattattagtctccgttatcattattctccattattctctgtgaaagcatcccgtgattttcttttgtccctattaccacaatatgtgtttattccgtgtatgtacatctttgtttgtttattgtttgtctatacctgcaatgaaatgcctaaggtcaggaactgtctgatgcaggatgcaatgcgctcaataaatatttactgaacaaattaattcatttgctcagtcttgcaggcaaatggtacttctgtatatttaaatatctaaaatgaaagcgttactcgttactgttggttgtcaatcaaaatttaaatgtcgatgtttaagcgtgaaagacctctgtcaagttaatctgtacttacccaaaggctattatgtagaagcgacataaatattttcctaaatgttgattttcatattttaagaagacaatgaatgtttcaaagcattttcttctacacagctatttattctggagagtggggcatatgtttcttaatattgttaaaattggcaaggggatactgttgctatatacaaagaacacctaatcatcatgcagacgttttgtttctggctctcagttatgaaaagcagagattttaaaaagttacctttatatgctaaattaggaatggcagaaggtaatattctaatgtttataagtggttcttctctgagtccttggtttctatgtttatgaattctctttttgaaagaaattatagttattattaccaggtctattcttttacattgtttctaattctatggtgatcttcaaaatagagtatcaattttaaatacttgggaatgaaattattcttcccatatcatttctttgtatggcatacattgtgatttgttgtcccatcattgtttcagtatgacctgttactgcaaaaacatattgagataaatcatcccacatactctcggccaggacagacatcacactgttgcagcaacacttcagatgagccccattcaaccttgtgtttttatagagaaggatgccacatgtttatattcatttctgaagattggctcatattatttattgaaacatactagtttaaaaatctgtccatttatataacacctggtctatctacataacttgaattacataaatataaaactaaacttcccctcttctccagtgtatagcttgcaagcaagtgcatgtgaaataaattaaagccttgtttgtgtttttttcatcatgtgagtacaagacttttcaataaaaatgaattacttttgaacatatttgtttggacaacaaacaagagaaaagatctatttgattgatagtggacagaattttcattaagttcaacagcagaaataccacaattgcatcattcaccttcgtgtatcaaaagaaaacagaaaattagatgtgatgaactctacacaaatgttcactatgcatactttacccattaaatacattatcaagaatcatgtcagcatgacattctaatatagcagctttacaaaaacatgtaatctaatctagggatgctgttgtcctctttaaatcagcttcaaacatattctgggttgatatttctcattcttttttgatccacattgtttattcacataatgattatatttaactgaagataacagcattatcaaagtgaaagacaaaatagatgtttaataggaaagtgagtatcgaatcatcttttttctaccaaaaacatctataattatgaagtatttggttaattattttcacaataatttaaaagtgtacaacttgccgatttttttgtactttctacttttcatgtctcgcatatatctctttaatatctaagtatttgagtcagaaaagagccagtaccgaataatgggaatctcactgaaatgtgataacaatctggggcctggtcctgggacctttatctgcaggacaacttggacaaatatttagacccccaattcctcgtctttaccctaggaataataacacatttttctgacctcatacttcacgtggatctcaaatggaacaatcatctgatagcactttatgaagtatatgaaagcaataaattatcacaataagataattgcaattattctttggcatagtattagtgatgtctttatctgtctgacaaaatcaacatttctgtatggtaactgcctttccttgttttaacagaagatcatgccagaaaagatgagtaggtagatacttaacttgttgttcctgaatctggaatgtattgcagatgtcccagactgatctttgttcttttttttccttacaaatttcttttcacattgacagtgtgatatttctttaaatgtgcaatacatagctaaccttatttgtttgtgtttactaattaaaatatctaaactgcttaaaggagaaaattcagttttaagttttattgatttatacccttcttcaatccacataggattagggtagtatgtaacaaaatttcaaactataaatgaaatattgagttttgtattaaggccaaggatgaggaaaaaaaaagtaagtatatatggaaaaagaatggtattgaatgggagttttgatggagcatgttgacatcatgataatacctattatctttatattctgaatgtcagaacaaaattagagcaattttcccttatttccctacaatacgtctgtcttaataattctaagctttcctgatttcagtagtaatctgtattttgcaaaaggcagcatgtttataagatatcaagtaaactaagtttatggaacttgtaacagcatttttaacaacatttctccctagatagttcatggtagacatgaatttattcaaaactagtatgtagaaaaataccattaacaaaagctctgaaattatattagaggagctgaataatgttacttgagaaagaataaaatgttatttatgatttttggtatcttttacccactatatatggccatatctctgaaaaactttagtaatatgtactaatgcaaatatggtagtaaattatgtctacaggtgctgataccatagtagataaagtatgataactttattttaaaatatcatatttaaataattaatatacagtactgggaaagactattttatctattctctcactcttgaataaaaaaatccagaaaaaaataccttgttttggtaagattatatcaatttatttcccaaatgggtagagggttatttttttctgatcataaacgtatgtctcttcattataaaaatccactaaaagtgatagaagaaaaccaaaagaataaatgtaaacaatgatgccattttccaaaaatcaccttcgacatttttctggatattgatacagtctaaatctcttttcggaagactccctcctgtgtaggttccccaactactctgcaatcttatttcctcttgttctgttcttgtagaaaggagacccattgtcaccatgtcaaataacacaaaatggtgcacgtataagatcattgtctctgtccattatttgccagaggacctcaaactttttcaggtggtgggcaactggatgtcatgctgctccttgtacaacagaacacaattcattatttatatggttatttcattttaagaaaatttaactttcattagctggaaaaaaaaagaagtggtttttaagttgtttagaaatgtgaaattcaattttcatactgcaaaagagattcaactgcaaacacaggcacacatgtctggtgtaagaacgagttgtcatacaaacccaaattagctgcctccacgttgtctttgttaacaagtgtttgtttgctccttgttccatcattcagaaatgctctttagcaggaattgatggaacacagtcgcagtgacctcttcctgtctttaaaaatcgagatgacatttgcccatctgcagtgttaacatagttcctcaaagaccactgacagtggggtaggactgtattgcgcaagttctctcatttccctagaatataattggtccagggccagagattttagctcatttagagcagcaaggtgctcttttaaaattccctcacctattttgggcttcatttcccttatacggttatgccttttccagtctgatgaacattctccttgacagagcagacaagcaaaaggagctgcacactgctgctttctgtgtcgtctctatccctaaccttctcccttctgccccaatcagtgaaccttcgtctttctggttcttcttcctccaaatggaagtaaaaaggccctgaatgttgtctttaccattatcacgagcctcaattcattccaagctcagcttttcctcactgtttatacagttctatattgttcttctaatatttgccctcagttctctgtccctcgtttcttcccatgttcatactctattagaatctgagcacctttgaggttgtccatacagtggcacacatctttgttttatactcactgggatgatttgccattatattgtcaaaattttattctaaagagcttttacaggctttcttgagccattttctcttgaaattcaagatcgttgaatctctacgctttttccttcttaatctaataaacatacacccccacatacacacgtgtgttcctgaaagacagatgccacttgactcgtcttatagattgtctaaattgatcattgtgtgtggggataaaagggtgaattgtataatatccctgatggttcacgaagtctgttcctgtataacctgattagtcttctgaactcttttaaattctgtctgcaaatgactgaggtttggcaatcagcctatttcagttagttgttttcttgcataagaagggtccatatgtactgtgtgaagtaagagagagaaagtacttagatttgctggatgccctgattgttagcatggctaaggtattgtgtaagtaaggagagcagttaaaaatgatattgtttttatttcttaattgaggtaaaattttatataagatgaaacagacttatttgggagaggaggaagagtttgttcttacataacatttcaacctgtcatatttagttgagaacttcaatctgtcaagatactttgtataatattcagattctgccatctaatatattttccacgctttcttactgggtgtgacagtaacttatactgtggcaggtgtataagttagtaaagatattaaatgctcaatctgttaacttttgtgaagtggtcccactgataaagtgacacctcaataaaataaaaatttccattacctcagaaagctttttcatgctaccttccagtcaattcccagccccaataggcacctattcttctgatttatatcaccatagattagttttgtctttttaaaaatttgtataaatgaaatcatacaaaatgtactattttgatcagcatactacttttgagattcatccatgtaagtgtatcagctgttcattcctttattgatgattaatattctattgtatagatataccacaatttatttatctattctccttttgatggacattcaggtggttttcagtttttggctgttatgaataagatgctgtggacatttgtgtacaagccatttgtgagcatatgttttcatttagtttgagtaactctgtagaagtggaatggctgggtgaaatgtttaaatttatgagatattgtcaaacagcacctaaacagttttctaaagtggttgtgccattttgcaatgccaccagtgatgatggagagttccagttactctacatctttgtcaatatttggtcttgtcagtcattttaatttttgctatcttacagaatatgtaggtatattgttgtggttttaacttatattcctctgattactagcactattaagcatcttttcatggatttattggacattcatatagattatgtgtgttgaagattattacctttatgattattgggtgaaaatagtatcattttgaggtcattcatataacttgaagactgggaatgacagacattttcctgttttgtttcttttctttttactttatctgaagagtctactagaatgcagtgttgctgcctgagcagcagggcattagctttgtaaaagctctgttccttggcaaccccaccactaatatgaagtgcagaacatttgaattgtctttgaccagcttcagcatcagcactattttttttttttgctagacccctagtaggtatttaaaagtacagaaatagaatttaatcatgctttttaccaaatgtgctatgctcttagagattctttcaacgtgcataaaaattctgcagtttcaccacataccagtaaaagaaactcagtcactcatttagccatttagtaaaaagaacaaattaactgatgagcatagtggagacctcaaaggtaaagaagacaatgtccctgaaataaagacaatcataaattttcaatcaaaataatgaaatttaggctgggcatggtggctcatgcctatgatcctagcactttggaaggctaaggtgggaggattgtttgaggccaggagttcaagaccagcctcagcaaaaaagtgagaccctgtctccacaaaaaaattttaaaaattatctgggtgtggtggtatgcaccggtggtctcagctactcaagaggctgaggtggaggatcaccagagctcaggggttggagactacagtgagctatgattgtaccactgcactcaaacttgcatgacagaatgagtccttgtctctaataataacaaaatttaatttttatagactgtgaaaaaccattatgtagatacagttcaagtacagtatgattttataggatagataacttttgcttgaaaatgtattcccaatttataggatagataacttttgcttgaaaatgtattcacaatagagttagtatttggggcacacctttatccatttaacaaacatgttttgagcactgccaggtagcaacacgttactaggcactagagtgagaaaagattacagttcctgctctcatggatctcatggtctagtcaactggaatgaaaggattacataagtagaggtaaagacacacatgatggaggatggagaatagtcaaaggtctggagaatgaccaggacgtcactgtgagttgtctaattgcactgaagcatggatgaagaattggaaagtcattgtaagaagcctaaaaaggtatctctcagggatgctatgaggttctgaatgttatgtacgctatttgggcttcaacaggcaggcactgagtattcagtataaatttttgagcagggaatccaccagaagaactatgcatctggaggattaatctggaaagattgtgtagaatgttatgcagtgaaagagtctgagatgaaacagttaggagggtgtattaataacataggtgaagtgtaatgaataaccaggctggaggaaaagcaataacgatggaatcaaccgggcaagaagtataacaattaggatcagtaaaatagaatttggattggaggaatgaaaaaaaaagggacaaaacaaagttgaactgctggtatccatactggaaaatacagatgtcattcaaataaataatgtaatgaatataagaaaccagttttaggagtgaagtggatgttggcttgaaaatatttcctttgaggtttcagtcaaatgaaaaggtcctgaaatgctacgtggtagcctaagaaggaagcgttcctagagagaaaaaaattagaaaagatttacatttgataatttaatcttttccttcatacaagctaaattgataagaaagtaaaacctatagttttcaccactcttttacaaatatccctaaccttttagatattcacatgaataattgagaaaaatctaacagatgacttgcttatgtcatttgtctgctttatccttaggttcctctggcttatatattgttcaataaaatacagatcattgatattgtacaatgtactgataatggggagtgaatccatgcttgtgcattcttttttttttttttttttgatttgcagagggcgtgcccagtcaacaagagaggcacaattgtttttatcatcacctcttctcatctaattccatgaaggagagtagtattaccatacaacagataatgagttggaaaacaagaaacctaacctcagaacttaaggcttggggaaaaataaaagagtaatttgtgtttaatgcctgtataacttggcaagagggacatataaggcttagtgatgcccaacatgtgcttagatgtggattgttagttgatgtcttgggggttctgtaatctaagctaaatgctcaaaatcaattaattgatgttagacacagagatctgctttgatccctctttatcgtatttctaggccttcccattctcaagagcctgagaaacgacagctttccttaataacttgttatttgtggtaggagatgaaactttgataaaaacacaattatttttaaatgtctctttttcactctaggctgttgtatgtatttcaaaaagttacttttgaccctttccagaatgagaaagcaatcaagaagattataatatcttgcttagttttctgctcaatttatcaacaaatatttcttaagcaattattaagctgagcagtgctcagcgctgtacttggtgatataggaaatggggaaaagactgtctttaaggcctttataatagtaattacctcaacttgtctgtttcttttccttaccatttcgccaaattcattgatctatcttgttctcaaagcaatcgccatagttatattgtaacacagcattttctagggtgtccccattaagttgagagtgttgacaagaaaatacaagcttatttatcattgtaaaacttgagacacctagtagttaccctaaattaaatatttgttggagtcagtcacactaaagagaacacttactgcattgaacaatttacctacattagacagcatttaaagactatgccacagcaaaggcccatggaattcttgtgaacacagaatagaagtgtattaaggaacaagcttaattctgttctcttaaagcacaacactttctcaaaacatattttgaaatcacctttgaccattttttttaactaataggtgggtgggagttagggtaggaaaacacaagcagcttcatcaaaacgatattctattttcttcaaatttgtggggaatcatacggcctctcaattttctacattatgctaattatgatattaatctctctgccagcaaatgaaaataatacatattagatgtagcaaatgtcaataatgacaaaattagtcatcatgcagatactcagggattcccaaaatatgtttggattatgattgctagctttgagtttgcccagaatcgtttcaataaaaataagggactcaaacacatttggagcaaaactcacatcataaattttagacatagctctgccaataatgctctcagttatattttcagtcctaatatttcctctgagttccagaccagtatcttcaactgtctgattgatactctctccttcatttctgtctccaatgcattaagtcctgtgtatttactttccaaatgccacttggttccatgcacttctctccatttctgccactgactcctcctcaatccaagcgaccatctttcctcactttaactaccatgatatctcctgcttggtctccttacttctattcccgggctcctccaatccattcatcctccagcagagaatgatgactagcaccttccacagtgtctggctaataggaggtatccaatcaataattgacttacagagtgaaaatataggcatggcaaataccagtagagaactacagggttttagaaccaatgacattagatacttccatcaaatatttacagtgtataatcaagttgacttgcacattgtcttatttttgaaaaacaattttgttggctttttctatatgcacacatacatattgtatcaccctctacccgccaaatggcttttgaagaagtatttatgtggctccaaattgataatacctctagagagaagagaaattagaaattttaaaatgacctatgcttcctttcgaatatcacgtcctgagacagtgttttttgagttacgtgcaatatgttccacgatgaaacatttaatgtgttcagaggcatgctagtaatcatgtagaaagaattttatgcctgaagtcacatgttctataaccaggatcacttaataagaaaacaagtacagctgtggacaagatgcctttttatcagggaaaggccaatttgttttctttgcaaatctaagtaaatggagagaaaaacacagcccttaaatgttttctatttgtcctgaagttctcatgaatgagttagaaggcgagaaggattaaataaatccttgaacgtagagagagctaacatttattttagcaaactaaaacctattcgctttgcaaagttctgttctgtactttgtaacaacagttttctttaaaacaagagccaccaattcaaatgcctttacagaatgattgaatgctttcatgccccacctaaaggcattcaaatcattaatcaaacaaagttctaacgccaaaacatgtctgggaccagatttaaaatgtagccctcagtttcagagggcaaaaacttaacatatttatattttcctcactttaggtaacactgtattgaatctctgcttgaaattgaggagcacgtgattttttctttttggcccagggcagcatttcttggaagagaaagaaaaacaacccaagatacccttacaaaacatgtagtacttaaagctctttatgatgaattaattttggtatacacattaatagcagtgataataacaaatctatatatatatatataattgatatgaataagataaatacatcaaaaggaaatttcattacaatttgatattaggtaaatgtcccattaaaataaattgctactgtacataattttccttcagttcattggcaggatgtttgctttggaaaataaacagtctatttctagttttagaaggaattctcattattcttttatagcaaccattatcaggagcagatgggaaattgtaccaagagcatatctactattatacctcacaggaaaaagagagtattaaatgaaatctaacaaggcctgctcctgactctagttcctgtaacaaatgaacacacacatttgtatggtttcagcatttgtattagtaaggtacaataaatgtttactgaaattgaaaaaaaaaaagataacaggagaaagaagaggctaaaaaggtgcattttatttctgatcgttcattgtaaagactgctcctttttaaaataatcaaattttattttatatacagagggtacatgtacaggcttgtcacaggggaatagcgcatgatgctgaggtttggggtacagatctcatcacccaaacagtgagcatagtacctacctgatgagtagtttttcaaccaatgcgcaccctccctccttcccacatctactagtccgcggtatctgttgttcgcatatttacgtccatatatgctctatgtttagctcccacttataagtgagaacatatagtgtttgtttttcctgttcctgcgttaatttgcttatgattatggcctccaactgcatccgtgcttccgcaaaggacatgatttcattctttttatgactatgtagtatttcatggtgtatatgtaccacattttctttatccaatctaccattgtttcacaactagatggattccatgtctttgctattgtgaatagcacaagacaggacctttttatttgactgagttccttgcaaattactaataaaagatctggaggtccttagttaaaagttgaatctgtagtgccgttcaaatttagagatgtattttctgttcaagagaagaaagccctcattcggtcatgcttaatattcagctgtaaagtccaaaacatatgagaatgacacaaatggaaacattttataaatacctatacaaaggaggggcacttagttcccctaggcctcttaaaagtcctctagaaagagggtacttttatgctaactattaaagatgagtaacgaatttgtcctatacaacttaacagtatcgtcaaggaagtagaaagttactcagttttactgggcattggagctaagcttgaaagtgaggaggagaagcggcaggagacggagccgagaaggcagtggggagaagaggaggatggtcctttccatgctccctgttgtactaacatgtttggatattatcttatacttcatatatggactggattcttgtccttctcattctgagctctccttgaccttgattcttacctcctataactttcattctttctttactcaaaaaaaggccatttatttcagccatttttcactgttttcttatccttcctagttgcttttctatactatttttccactcttttttttttctatactattttgcccttctctccattttcctaactgctagatttccccaattttagccatctttcaattgttctgactatcctcaggtgctcccacaaggttatcagaccttccaccaagacggaatccctcagtctatggacaggctaagttgaatgggtcctggtgctgtgcttagcatatgccttgagtatttgtgcatttattttgcttctttacaaaaatccatcatccgatagaagttgaaagaaacttgctgaagcacattaaaatctctgaaaacagtattggctatattttctaataattagcatgactggttaacttgctttatttatcattgaaaaaagtatcagaaactgtatatcaaactcctgaattcttggcactgacgaagagacacaatgagaatgaccttaggataaaaaaacaagataaagcaccatatttgtaggaaattgcaccataaaagtctgtttcacaactctcccaaatttcattttattacatcttttctcttgaccaatcagtaaactcggttaatgatttacctgtctcaaaataattcatgaacaaaattacaagtaaatctcagtattggattcttgaaacatctccttgttcaatgaagtttcctttttcttccctctatttccctgtatttatcttttcttccagttgcattttatctcttctgtttttttatcttgctccctagtttgtgattttttgccaattttttatttcctacataattcatccaatctgtcattgtacaatttcttataactgcttcttagcttattccttttcttcatttgtcacattctatttttcatctattgtgttttcatgcagttttggaaagttttacaaatagacttttaaaaaaatgtacgtaatgttttcatagaaaaggtagtggtttctttttcttatatccttccctgtataaaaataaaaatgtagcagttctttctttgcctatgtttcctctttccttcccccaatttgaccagacttgaaggacttagatatgtaacagtgttattttctataatttaggaacagcttttgacttaaaaagcagaagagaagttgaaaataatatagtaattctacatgtccttcctgcttcccaactctctgcacatgtttgtaacctcccctttcttttttagtgtatctctttcatatacctttgtccccagaaattctgattcagtagacttagaatggaattctgggcttttatattttgaaaagctccccacgggagttagatatgcacttcttattaagaatgaatgcttaatattggaatcaaaacacaataagctttctaactatgatgaataatccaacagatttaattatgattttctttttgtccagaaccaagactagatgttaattgccagagaaatagataagaatgcctatgacagcagtacattaatatgatatcaaagcttggaaattttattggtaatgaataattcagtacttaaaatatttagaagctatagaattaaaattaattaatgttgttcactgtgtgaataaagttgattgagattttacatttaattttgtaaacccagtgttatcttttccagctcagaaaacaccacatacaagctactactttctgttttgatcccttatttttctttcttatgctttatcactgaaaactctccttgagcaggccatgcactgtaaatatttctcctggttgcaaaaccttctcatacaaatgcagtagactgtgtaatgagctcttctttcacaaaattaaaaaaacctgaaagccctgatttgcgattctatacaaatgagatttagatctaacaattttaaattattgcttcactcttagctgttcaattctatctcttatttgggaaaccgaaataataaaaccattgctgattccacaattaggttgtaaaagtcaccgtagccatcagccatgaagcaaaagtgccaagatcaaaactacaaagcaaagaggctgagataaaaatgctgcagcattagtttatagcattataagcagcaataagaattccttgattgcttaacaaagactcaaaaggcatttactccattaccttacaactcaaagaggtattcctggaccagcagtattggcatttttttgaagtttgtaggaaatgcagaattttggtgcctccacggacctaatgcagcagaacttgcagtttagtaagatctccaggagatttgtatgcgcattaaagtctaggaagcaccgctatggtatacatctgatgtgtgcccatgcattttttaaaagtatgaagtaatagttgtaagtattggacactcttgaaggaacaaataagagccatggtctttactctctaaatacctccctgacatctatgttttaggcaaaatttttttcccatttcagtagtcactgatgcttgcacgatgcagtttattccaaaacaatggtgattctcatgtaatagttcatgttgccttaataatttacgttgcctcaagttctctgcccaggccccaatatacaccgagggctgtactcctcccctaacgcctgctctcatacagtggcatagagcccagttttatgctcttggtcacatcatggagattgcacaccacaggctttaacttctgccgtactctcactgcctctaaccctccatatgcctaagttctacgattctttaaattccaaattgacccagaagtctcctccgctcatccttttcactgagatcatccctcttctggcctaccatttgttgatcaccttgctttttttttatcctactgtatgtagtataacaaattatcacttgcaactgtgtcttattttttcaactagattatgtactgcctaagacctagaaaattgtgcttatttatttgaatctctaggaggatcagtaatgggtattaatactaatgactccatggtgatgatgagcctgaacttcctcccttcctttctttctacctctctcctttcctcccttcttttcttcctccattccttcctctcttcctccctccgcttcttccccacttcccttattcatagattcatgcgttcactcagcaaatgcttactgaaaccttccatgcatcagacattgtactaaacaataggaaactatcatgaataagacacaatatctgacctcaaagaatttatgatataaaagtaatggcataaaccgtgattacttttgcaccaacctaatatatagacacagtttgttatgactggtgtctctattactaagcaatgactgtcacatgcaacgctgatctgaacaggtggtaaagagtgagatgtaagcaatggagcaaagccaactagttacaaggaaatatcacatgtttactagagcacatctcatgggcattcaagagagtatggccaggacagcttgtgaatagttcagtaactgtgcatagttttatattcattgtgaggcaccgtgtcaccggtttgctgatttacagagtattttaattgctaactgtatgctaccaaaatttccagtattcgaaaataattttgcttgaatgtagaaaaagaaaaaagccaagaaatgtatgtgaaacgagagtctaagggagctttacctcagtctcagaaaacatgcattccttccttcatttaggaagcatgtactggggtctactgtcagcttgctattgtgtcaaggagtaggagaatacaaaaatattagagaatatgaatcacatctattaggagagttttctacatacgcacattattctgtcagtgacataaggatttgagtcattcagatttaaatacggtaggtacctcaagttctcagatattatttcattttctaaggttcgtatttagttaatatgttattttaatggccttacaaattctagattatcttttttaaaaagttaaatagaacgtaattgccatttttatttaatggtaaaaagcatttttgtttttgtgtgtacttggttgtaatattctccttttcaattgagctatttttctgatactttactcttaaaatttcattcaggaaaaaagtaaacaatatttaagcttgacaatcataaaaatgctctggtgactatagattattttaaaatttattactgtagcttagggatatcttgatgggatgctcctgaaagcaattaattctcagttttttgtggcttctaatgcaaaatacattgacgcagacagaatttgaaatgaattttcttctaatatagcaattaattttatttaaatatctctagagtttttttttaatactgtgactaacctatgtttgttctttttcacctctcgtatccacgatcactaagaaacccaaatactttgttcatgtttaaattttacaacatttcatagactattaaacatggaacatccttgtggggacaagaaatcgaatttgctcttgaaaaggtttccaactaattgatttgtaggacattataacatcctctagctgacaagcttacaaaaataaaaactggagctaaccgagagggtgcttttttccctgacacataaaaggtgtctttctgtcttgtatcctttggatatgggcatgtcagtttcatagggaaattttcacatggagcttttgtatttctttctttgccagtacaactgcatgtggtagcacactgtttaatcttttctcaaataaaaagacatggggcttcatttttgttttgcctttttggtatcttacaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggtagggcgacagatctaataggaatgaaaacattttagcagactttttaagctttctttagaagaatatttcatgagagattataagcagggtgaaaggcactaacattaaagaacctatcaaccattaatcaacagcagtaaagaaattttttatttctttttttcatatactaaaatatatacttgtggctagttagtggttttctgctattttaaacttgaagtttgctttaaaaatcacccatgattgcttaaaggtgaatatcttcaatatattttaacttcaacaagctgaatctcagttgtttttcaagaagattttagaaagcaattataaatgattgttttgtaggaaagacagatctttgcttagttttaaaaatagctatgaatatgactatgaagctaaaaaaagtgatagtgtcacttacctctagtttcaccacatttgtgaatacattcttgaaggggaacttgagccaaagaggtacaagtttaatggggaaaacaaaacctcaaaaaggttactgtcaaattcaatcatcatttaaatttcccttggaatgtattgaaggcacagaaagccaaatgcgtgctgctgcagttggaaagcctagagagtttataaatgggattttgtattatgcttccagttgttgatgttaatgtgtcttgtttcgtaaaggaagacttggcctttatttaccaaatgagactattgttatgaacaatgaaaacttcgttcttttgccaagctcttgcatcccacccatcatccacataataggtggattttaatattcaggaagctagaacaactcattgatgaatatctttcgttaagatgtattaaaaagaagattttggaattatgtcagttgtctttgcccacctcctctttccctctttattcatgttacattattcagaaagtagatacaattcatattttgtacaaaataaacacattagttgacctaaacacacacacacacacacacacacacacacacacacacacacacacacacacacacaccccttgccaaagttaaagaattatagcctcatcaaaagatattttgaataattaagtcttggttttgaaaatcttcttgattatagatagataaaataaagaactaaactttgtagttaaactacttccttaggtaagtcatatacttttttcccagattgaaattcttctcttaatcatacaagtattttattatttagataactgatgtgcttatactatgaacaggtataaacctgtataatgtcatttctgaactaggctcaatctaatccaaattaagatggtaagaaatgagaaaattaaaaaaattgaataccatactataaatatatatatacggagagaattcataaagtggattaaatcgactggaagattatttttctataatatataaagtattgtttcctattttaaatgtcttactcatatagtatttgaatagagtgtattaacattccctctgataactctaattcacctgaattttcaaaatcttgttatctgttattgggctctaaaggcacattataatttataaacaaagatgtagcaatatgcctgtttcaccaaataagctctaaaattttagatctttctaattttataagaaagtggtatatgctgactctgttgtgaaatagtatacaaattttaagttaattacagctagggatttggctgtaattaggaaaaaaattttcccatttaaacatgttgacctacattaaatattgcacttcagtgctttaaaaagtcaagttcagcttccttgagttttttttttaagctgagcttttaaagttgtctatttcacgctacattttaaaaataaatgttaacatatttaaatttccactgagaccacttttgtggcatacttcctcaggatttttatatcacttaaattttatgaaatgtaaaaatgtaataaaatataagtactggttctaccaatatactcatagctatttctaagcatccagtagcaaatcaagtaaaaattaataaaataatattttatgaataatatgttaacctaacaattaattatagaagggctgtaatcacgaacctattgctaatcaatagtgtactctcagtgcaacgcaagcagatgttagaagggaatagaagttatttattgcaccggtgaaaaatatataagatgcctattcaacttaacaacagtagtcttcgtttgtaatggactttaagtacagcggttagaaatatttaacattttttagtccagggacatcaatgaaagaaagtgtataaattcaagctagatgtctatatggagccctgtagttgcaaaactttaagtcttctgaaattttaagatattagaaataggaaaaaaaatctcaaaagttcaaataatagtggacatccaagaaggttagtctatgttggaagcaaatgaagtgtgaaatgtagtcagttagcgatgcagtttaagatagacaattcactacagcttcaattatgtaacagaagaactggatacatctataggcttaagcatgataataatgagtttaatgatggcgtagccaccaaaactgtctttgtacacgaaggaggtgcaaataaaaacctatcatcggctgtaaggggaagtcataggttgatacaaagcaagcctgtgtacaagtctttaagcaagcgtccatgaatagcaaggggcgccatgctcttcactggagaagaaaattacctatttgtctttactaacctctaactgaaattaagcattccttttcattttgaaagtaggcaaaaaaatcacagtagtacaatcagtacctatgaagtcacagatatgtacacatctcattacagttataataaatatatcaaaatatcatttatgcttatcactacttcaaaactgcagtacttattatatgtgctacagggtcttattgttgggctttaaaacattattctgaggaatgtcaggcttcaacagattgccaaagaagtccaaggcataaaaaaatgatcctagccagctgtctgtttatctgcccagaatctcatcctaatttactatggtttcagtcattttaatgtgcagtcactatcttcatacactccttttcttctggagtattctaggagaagacataccagtcgaggggttctggggagccaggccttcaagcaatggattgctgacaacataatgaagaggattttacttagaataatgtcagttgataaaagtttgaatgggagacggaagcaaggcagtgggaagtggaattcctaaattgaggaacctctgaatcataatccttagcaataataattaagatttcaaaacattataattctttcttcttttagacaagtctgatattgcttatcccatatcacagataaggcaattattctactaatatgcattaaggaatagtggttttaatttaagtgttaccttaatgaaaataattttgaattttttccttccccaagtctttttgtgaaaaatttcaaacatatagaaaaattgaaacaattgcaaaacatatgcccatttacactgttttcctccccctaaattcttagagtcaacaattgttaacattttgccatatatgctttttttctctcgctttctctaccctctttctgtatctctcatatatagggcatcacacacacacacacacacacacacacacactttttaacatttttgcaaataagttataaataccattatattttacccctaaataattcagcatgtgtcgctttgaaatacagacatgccatatataaccatgcctgtttattatgctctcctccaaattaaatataatactgcattattgttaatatccattccatattcatatttccttaatagttcaaaaatgtcttttatattttgcaggggagttagtaccaatatcttatcatggctcatgcattacatttggttattattatttttcatccttcttagtctaaaatagcccttccacatttttttcaccgatattgaaatttgaaaatgtccaggacgctagcctcaaaaaatgtctcatctttcaggatttgttttattttttttcccctgatgggatgatttaacttgttctgtagtctctgaatttctagtaaactggaagttaggtctaaataagacttcaagagatgcatgtcaaacatgtttggcgagaatacttcatatgagatgctgtgtattttgtattacgtcacatcaggaggtgcatcatatgaagtagtctcactaaatgctgcaaagttttattacttgcttcaggtggtgactgacagatcttgcattataatgtcacattttttcttcgcaattaataaatcatctaatggctttagtatccattgatgatccttccctaactcagttattacactggggcttgcaaaatggaggttttcctaatctgacatgatcttaacatttaccagctggctttcttctgtttgaaaaaaaaaaaaaaaaaaggtttttcctctatatttatgtcaaaatggactcataaatttttatttattcaatatattattatgaattacagttattattcttgcccagagcttcctgctcaattgtcccaggctcaccttggactttgcctatcccagatttagaattacccatttttttcaaggaactctggttacttttagaggtgaatagtacgtagaaacgtacatctgggtagtagccccttctcaatggaatgtgtgcacctttctggcaagcagtcccaaaggagataatattttcagattaccttggaaatgattcttgacaaatctctttcagaatacatggaagttaaaagtaagtctagacatgttaaaaagcccttcttgtgtgagacttcatgtacggtcattaagttactactcctttaaacctctctacttctgaattcttaaaccaaaatgtactagtatataatctatgctggtttgccatgcaaattaatggtgtaaataagataatgggaggcattcgtaaatgtacttaaaggaagaaattattgtttaaagaccttagctcattgtttgcatgcaaatacacgctgttgattagaaatgagccttatctaattcattaaagtaggcctggttggtcctcttcttgaaagtctccattagcaattcatattgctctatgcgcttccttgtaagacaactgttgtctcttaagttttctttaactttggcttcttacaaattcagaccccacccccaaccaaatagctttcaaccaaatagcttttcagcatcttatttcctacaaattaaaagcgaatattttaatgactcaaatggctctttacagtgtgtgcaatatgttaaatgtacccagtatatccgtgtgaaccagtgctacaagcctgctcacacattcacattttgcccccaggatctgtcccgtccgcttgctctgtactcaaacttcctttttttctcattgccagtttagaccttgactctccatccagcccagagtttggaaactgagtacccacaggctgaatcctgaatgcatgcagtatttttgcatagccactgtttttaaataattgacaacttttaaaaattgagagacctcattttttaaaaaaatatggatttctgtcttcttttgaaaatttagatctggctactaggcactcattactatattttctcttggcaccatcacctacaactgagtaacagatgtttcattttcttgctactcaaagtgtggtctctggtccagagcacagacatcacctgggagttgctaagaaatgcagaatctaataaataacagtcagcatttttaataagatttccaagtttccaagtgattcatgggcacattaaagtttgagaagcattgcctggggtaagcaagctttgtcctcagtttgcagcacctgtcccactttgctcatttatattaattgcttttccatagatatttgattttatagtacctcatgcagacctttgtatgatgatgacggttagggtggtgatggaagtgatggtgataacacttaatattgccatgcactgttccaagtgttttacgtagctcaatacttataacaactctatgaaatagttgctattctccttttaattttacaggagggcaacgaaggcacagactgataaaactctttgcccaagattgcacagccagcaagtatttgaaccaggatgcagtcccgcagtctgcctccggagtccttactctagatcagattttgcattatttatcccagttttgtccatcaggattctctggtatacacttgcaatttcttcctaccaaccttctccttacctttgatggccacacgtagtagcaaaagaattgaacatagaatctgttctgacctatctttccaaccctgtttttcataatttccactatttctgtttatgtctgaagctttgaatgacctgaagttttctgttcttcagcttttgcaaaaaaaaaaaaacaaagaacaaaaaacaagacaaaaaaaaaaaaaaaccgcttcctttggttgaattctctttccccttattttttttcccaaaatcttacacatcccttaagactcatcttaactgctattacctcaatgaattgtgacctgctcttctcaaacataagcagtttattctcttaaggttttcttgcccctttttataacactcatgtaatattgtatgtatatatcatgtatcatacctatttacatatgcttttcccccagcaagattaaaagcttcatgagggcagaggactctcttattgttatctctataacccacagtacttaccagaaagcctgatatattgtagatggccagtaagtactttcttaatttaaatcgtaagaattttattcacattcagattaaactgaagatttaaatctttacacttgacattattatatagattaaaaatagatctaaagagccagaccaatttttctgtttttatcatgttatcacatttccatggatacgtttgcaattctagaaattgaccttgatcccttctagtcttaaaaaaatggaaggagtttggttaataatattttaggtattcttcagaatttagtacatttaagagacaagtaacttcaatttatttagctagttatggcaaaaagcagctctttgattcaaacattttgtacatttgtttatcctactctcactgtatctcaactaataccttttaagtgaattaagcaggaattagccctgaaactgaatgttttagcctcatcctacatatagccacaagatgttttagatgcaatccatatcaccaaagagctatttttagattgatcagagagaatcatacagatattattattcacaggtgtcaatggaaaagctggtctcttcccatctgttctctgatgactcttgaaaagctttcaagggcattcataattcttcatcaaaagactatgaaaaatcagcttcatagttaattgttttatgtcatattttattttttcaacttggctagttctagtgaaacagactagctggcaccaaatatgttgttgcattggctggtaatgatgataccactgtgtggagatatacaagtgaatgtactttatttgtggccttccatgaactttatgtgcctgggaaagtaggagttagggagagtttgttagggaacgtgatctctgggatgggtcttaaaggatgagaagaggcaaatgaagagtaaatggacatgccagagagaaaaagtgacaggagcaaaatcactgaagcaagaaaaaatggcctacattgaaggactatacacagttcagtataaaaaggctctgttaagcaagcaccattgacttaccctaaactcttcattttctacatataaactgcccaattcccactccaaacctattgatggatattagtaacctattgatgtttttgaaaggtgttcaagtatcctttctggtaccatgtaccttggctcccaccatttgagagtatgttctccaagaggcaacagtctgtggttcctgacctggctatgcaagttattcttattattaaaattgtcctatttaattaaatatcatgaaaactaatgaaatagaaatgaaaagataagagaattgtggtttctatgaatactaaattgaatgctttggaagacttgataaaggtgattagaaaaaaaaaaaaggccagatgcggtggctcacacctataatcccagcactttgggaggccgagatgggtggatcacctgaggtcaggatttcgagaccagcctggccaacatggcgaaaccacatcgctactaagaaaatacaaaacttagccagacgtgggcctgtagtcccagctacatgggagtctgaggtgggagagttgctcgaacccgggaggcggaggttgcagtgagacaagatcatgccattgcactccagcctgggtgacagagtgaggaaaaaaaaaaaaaaaaaaaaaaccacggtgctgttgaattagatgtaggtaagacaactgtttaagattgggtatgagggatagaatccccaaaaaatggaggtattttgcattgagattattttcagcatctccaaatctgactgtaattcaaagaaaccaaactaaaagtcacagattatgaaatgtagaagtgttttatgcaaaaagtaatatgcttaacttcaacctgtgggcttttactccaggaaaagtctcggaccccataccaaatgagaagtaaatgagtgaccacttgtatattctaagaaaaataaaatgtttgaagatgtgtaaacacatttatataatccctccaattttacaatatttttccaaaaaccgcctatccacttaccctaatcaagtttgataaggggacttccttttatatgtaggaaggctgaaaaatgacgccatgacaaatgaaattgtcaagatggaccaggtcatggaagatttgaaatctcaaagaattttttccagggtagaatataaggatgttgggacgtttttatatgctttagatttgcatcctcatatgtccctttgacagttgagctcagagtgaaaaaaagagagtgaaactagtggcagggtgactcaagttagagacaatgagtaagcagaatagaactttaaaaacctgacagattcaagaaatacttgatgaaagtggaacaatttagtcgttaagtagatgggatgatgaggggaatgaagggacaattctaggatgatcccttttccaggttttttgcttgggggaactggctgcatggaaggctgttagtcaggataggaaatacaaaggagagtaactgaatggaaagaggaaagcaaatcagacatacagagctcaacttgggatataatagtcttaaggagctcttggaacattgaaaataaggtgatcagaaaacacgcatttgaataggtaagtctgaacatcaggaggaagacaagggctgaagacactgagccattttgctgtcaatgtagagatggtggcaatctccattgaactaactgcttctcaataaggtacctttctcaagtcattaatttgctaaccagtaaacaaaccagaattcccagagtacacattaaccattaagcactgctgtggaaaaggagttcaggtgtcaggaagccaacgtggcagatgagcactagtggtgacaaatgaaccaaagtgatatgggtgatctttatggggccacagagtaccactgtaaactatcacaaatcagaagggttgacaaacaaaatattggggataaatcagggaaaacctaccacaacatacaggaaaataagttcaaagatttcatcctacagattgcagataagaaatgagccctttttatttggggcaccctagggaaagagtagatgcccatatgtatatttaaagtatgaatacagcatttatttgaatatactgcaaatggtcaatacaagggtagctacagagcccataacatgaaaaggaaacacaaagaaatacatgccccagtcagactccttacttgggttgctgtaaattctctctccctttaaggttattgcatttaaagtctatctgttgattggacccaacagcagctgcaccaagactgtaccatttttaaaaaaaaaaaaaaaaaaaaaaaacaggccaaatggcattctgcatttattttccttgttgctgaagaaacttgaattgtctaccctcaaagcctgtcctttgagacacattttataattagaaacacttatttacaaagttctttttatgttagaatcacaaatcataacactccaaaaaaggaatacactatcctcaggtgagtgtcctacctttgtttacaaaagaaaacccaaagtcctaagagaaaaatgtgttgatcattttattgattccttaccttggtttaatatagttaatggatgtcttagatatgtataataagtctattatcatgttccctttaaaattctcttttgttttactaattatatgttgtcatagtttgaccattaatataagtctaaatttattataatgtgattttttctacaaaggttaatttgaattaaaatattttattttatctctctctactatgataaatgtttttaaaaatcgtttgtaaaatgaaagtactatatttgtgtaagctgccaatctaacaatttatcatttaccattatgatggtgaatgtataacaatccttatattcagcagaaagccttatctctcatttcagaggaatcttgccccggttaattattctgtctcttgaatgcacacaaacacaagcatatctttaccctttttctgctgcctcactatccctgatcaggtgaatgtttttagctcctagattacaatataaatatattcagacattcctttccaaatgcattcattccactgtacttgtcagagttcatagctgtgaataacagaacccagtttttgttgatagaagcggaaacggactttaggagaaagatacagacctgttcccattcctaaacaaagggatagaaaaccagctcaaaatgggcagaactcaaaaaagaggctcagctccaagaactatagtccaaatcataccctagattggatctcgaactcttggactcaagcgatccactcatcttagcctcccacagtgctgggattacaggcatgtgccacgacgtctggcccccatacactagatgtaaacgttgccatgcaccactctaccactgcagacactgggtgaagaatgtcattgctactggaaagaattctagatagtgccttataattctgtcactcattccagattcaaaaactgaacttcccccatcagattccatttgtatttggggattttgttcgacataatcagggcattcagattctgggcaaccaaagttaacaaatgtctcttacttcccctttcttgttattattcccatttgaatcttcttcatagttagtcactgttacttaaacacacattctctattatcacatttccctctcctctcttttgctgtttgcttttgatccaaaccactgctcagaaaccattattgccaataacaacaatgatttcttgtagttaaatccactggacatatcttagtcctattatccgtaggccatgtgccattaactgaacactttccgtattagcacttggtcctatcttatcttccaagtcactaatcttatctgaatttattcttacctctctatgtaattccttactatattgatgacactccttgctttacctgccccttacatcctgatgtttctctaggacatgttctgaaccctcccttcttctcattctatacggtttccctgattgttatccatagcaacaaatgtagctttcactgtatcaattagaataatatctagggagattaaaaaagaattatagtaactgaaacaaagtagaaatatattcatcttcttgtagaaggaatctgccagtaggtagtccgaggttggtatcattgctctatgatgttgaagatccagatcccttctgtctcacagatctgccatcctttggtgaggtccttacactcatggatcaagatgactatcagctctctatctatcacaactgcttttcaaaggctgcaaggtgtaggaagtggacaaaaaagggatacctctacccttttaaagggacttcatggaagatctacacaacactttagcttgtatgtcattggccagaatttattctcatgacaatgccaaactgcaatgggcattcaaaatgtagtggaatggatcatgggctaagcagctaagcagtctctaccaaagtcaccgatttcattttatggcctaagtctaatatttggcccaatatatagtttcagattagacctacatatgtagcttcaaatggaccatttcctcttctatgtctcaaagccatctcaaagtcagtatatccaaaactcaacatgttatattcctctcccaaaatctactgtgggtgatatcactatctattcatgtacccaaactataaatttggaagttacaagagctagtattaatgacactaagttttgtgcatttactctatgaacaggactttgataagagttttacaaatgtttcccacttaattgtcgcaatatctcagttatagagattttatacgtccatcatctcacctgactcttcgagatcataagcaaagcatggcagcattcttatgtccattttacaaattaccacattaagcacaagaaaaaacaagatatatgtccaaggctaaccaaagttatagaaggatcgagaactaaaagtcagtgatttagacccagatctgtgccttttcccttattgttacatatgaccatatctagctatgtgaacaaagcagctaatagtgacgacagggtagaacaaataagaaagtgaatattccccactacatttatgattatttgccagtttaacagcttcaagcctgtgtcttctcagatatgtgcttcctcttatgtctaaggaaaagtactatatttgatatgcttttatgaactttcttttttgagatggggttctggctctgtcactcaggctggaatgcagtggcatgatcacagttcactgcagccttgatctcccaggttcaagcgatcctccaacctcagcctcctgagtagctgggaccacagacacgggctactacacccagctatttcttttttttttttttttttttggtagaggcaggatttcactgtgttgcccacctggtctcaaactcctgaggtcaagtgatccacccacctcagcctcccaaagtgcggggattacaggcatgagccaatgtgattggcctgaattttttaaatttaattttattgaggtaaaatatacctctatataaataaaagtaaatatacctttaccatttttaagtatacagttcagtggtaataagtaaatttatgttatttttcccctttgtcccctctccctactcctatttctgatctctggtaaccaccaaggtagtgtctactttcatgagatccatgtttttagctcccacatgtgagtgacaacacataatatttgtctttctgtgcctggtttaccttacttaaaataattacctccagttctatccacgttgctgcaaatgacaggatttcaccctttgtatggctgaataatatcccatggtgcatatatatatatcacattttctttatccattcatcctataaattttaaatggtgtggaatttggagaatacttaaggaaaaatgacgattgtgtaaaaggaaagtatctacaaaagcaaggtttatctaccccataaagataacaagagaatctgtgaatgtggatacggtttctggagtgtttcagaggttgaaagattgtgaagaactggatgggtataaaaaaaagtgaggaggagaagaaatgaaagttctggaatgttctgtaaattgtagatgagttccctatattaattttaaaatgtaaattgagattataattattttttgatgatctatttttgctgggctgattctctgttggtgtaactctttaacgaatatgggtcacgtgggaccctggattttattagaattacatgtgcgaatcaaattctaactttatgagccaatataatgattgtttttttaatgattagagtctatccatgacaaaaacagcttgtttctcctactgacttatttggtgttttcttgctaattagcctttatactaggcagtagtaaatcagagtacttggacttcaggttggccattacataaacctggcaactaaatgctgggtaataatcacctatcttcccacctgtgtttattacctttggaagtatgtaacatggtatctttgcgtttatatttttaatttgttcttttttctcttgcaccagctacttaaattatctgagcttccttttactaatccaaaaataaagataatagtacatatttatagagatgttgtaagagtaagaggtaatgtaaataaattggctagctctatgcccagcacatgagtaggtgcttagaagttagtgtctgggtacatgacttctggggatgataaagtgagtagctcgataaatctccccaagaatcagtaaaatgggacacactggagaaaacatcttatgaccctggatatcaaccaacggcatatgctaaattaaaaagtgattatttataaaaagtactaaactttgtatatgaacaatatgaatttgtggtgtatttgcctgtattgcccccagtccccactcccagcttggtcaagcataatagttctatcaaggtagaacaagccatggaaataagcagcttcatcaccacagggactgattttatttgaagcagaagtttaaaactccatgtccagaagcattgtcagtaacggtggagacctaggcggcaaacaaaaaggcagaatagcaactcagctggcctaaagttgcagtcttgattggaacaagtaactgactggcagactggccagaaatttaatttaaccagcatatctgcaaaatgaggcagccgtaataggcctcagtaaggactccttgtgtctccttcatgaaaacttaaaatgtgcctgcatgttgaatataccctttaacacatataaagaacctttagcaaaacttggaagtcttactggcttgaggtatttaagatcaactgctggccaactattgactaatgcaaattaagctatgcttacctctaggaaactaggcatacagtttgtttctgttgtttgacagagaaagaatatcaacagccacacactgtggggaaacagattccacagatttcatctaggcaagttattaaaacttcaatttaaaaaacgctgggcataagaaggaacatcagaatttggggctcctttaatatgttatttaaaatgtcaaattttcaagaaaaatttacgatacgttcaactgtgacccattctcatggggaaaagcagtcaacaaaagttgtctctgaattggcccaggtattggcagatagagacttaaaggctcctactataaataccttcaaacaactgaagaaaagcatgtttaaataattaaatgaaagtatggtaacaataactacaaatagagaatctcaactaaaagatacacactatataaaagaaccaaatgaaaattctagaattggaaagtagaataaccaaaatttaaaaaaatcactaatggggctcaagagcagatagtaagacagaaaaaaaaaaaaatcagtaaatttgaaaatagataaataaaaattatccaatctgaatgtcagaggtaaaacagtataaaaaacgaacatgagtcatagctttgtgtcaaaacattgagcatatcaatgtagatgttacaagagttccagaaaaaaagagaatgttgttaaagaggcagaaaaattatttgaagaaataatggccaaacacttcacaaatacggttaagctcaacaaaccccaaatagaataaacacgaagagatcaataccctaaaacataagagtcaaactattgaaatagtttcatttgaaattattgaaagacaaatgggaaagtctttaaaacaaccagaaaaaaatgactcctcatgtacagggatcacatgattgatagttaatttctcatcataaacaatagaggccagaggtattgaaatgacatattcagagttctcagagaacacaaaattgccaaccaagaattccgcataaaacaaaactatccttcaaaaatataggtaaaataaatatattaccaagttgagaatgagaatatttcttgctagctgacctgacttacaagaaaaaactaaataaagtcattcaggctgaaaagaagtgatattcagtaactcgaacccaaatgaagagataaagaatcacagaactgataaatatgtagatacatataaaagactgtacaaatatagatatatgtttttcttcttttaacttctttaaaagacctaagattgcataaaaattataacattgtgttattgtgtttataagcaggaggagcaaaaatggagcttagcagagaaaaatatctaaattttactgtgttaaattagtttgaacttaagtaaattatgatcaattaagatgcatatgtaatctttagagcaagcactaagaaaataaatagttaaaaacaaaatttaaaattacacactaaaaataactaacaagacagtgcagtaaaggagaaacaggaacaaaaaagacatgaataagatgtgaaaaaatacaatatggcacatgtaattgcaactaaaagttgagaattcccattaaaaaaatctgaaatttgaaatgctctaaaatgtgaaactttctgaaggttgatataataccacaagtggaaaatttcacacctgacctgtaatgagtcacagtcaaaacacagccaaaactttgtttcatgcaaaaaattatttaagatactttataaaattacctccaggttatatgtataagatatctattaagatatatatatatacatatatatatatatacatatatatatatatacacatatatatatatatatatgtatatatatagtatgtgtgtttaaacttaggtcctatctccaagatattaggtatatgcaaatattacaaaatctaaagaaatccaaaatccaaaacacttccaatcccaagcattttggatatgggatactcaacctacatatcaatagttatagtaaatgggagtgaactaagcattccaattataggcagagatttcagacaggattatttaaaatatccaaccatagtttgtttaaaagagaaatgtattagagccaaaaccatataatttcaaagaaaaaagaggtactatgcaaattgtttacatataaaaaatgaagtgacaatactaatgtcagacaaaatagactttatgacaaaatatgtaacaagagaaaaagacatttttaattatataaggggtcaattaagcagaaaatataacaattataaacgtatataattaataggaaagtcccaaattctatgatgcagaaattgacagaattcaaaggagaactagacaattcaacaattattattggagacttcaaaccctactctcaatagctggcaggccaattagacagaaaaatagcaacaatatagaagaattcaccaacactatcaaccagcttgacctaactaacatttataggagacgccaccaaatgaaagcagaatacatattattttaaagtgcacatgaaattttctctgggatagattctatgctaggtcaaaaaacaaatctcaatacactcaacaggcttgaattcataaaaattatgttctcttaatatgtcagaattaaattggaattcaacagaaggaaatttggaagatatcaaaatattttgaaattcaacaacttctaaatccattggttaaaaactaaatcacataggaaattataaaatattttgaactgaataaaaataaaagcacaacatgtcaagatttataggatgtaactaaagcagtgcttacagggaaacttctagttttaaatacctattttagaaaagaataaaattcttaaatcattaactcaagctttcgccataagaaactagaaaaagaagaacacagtaagctcgaaggaagcataaggaaggaaataacgggggttagagcagaagtcaataaaatagaagaagaagaaagaaaaatcaatgaaaccatacattaatctttgaaaatattttttacatggagaagctttagctagactgaccaaaaaaaaaagaattaccaaaatcataaaggaaaaaggggtaattactaccaaccctacagaaattagaaagactagaatgtaataacatgaacaacattgtcaacaatttctgcaaaacatattaaatgaaaaaattcttagaaagacataaattaacaaaactgattcaagaaaaaaatagacatatgaatagacctaacacaaacacagaaactgaattagtaatttaaaattttccaacaaaaaaacccaggtccaggagaaagataggaatccgaggcatccacagtatagaagaagaaatgaaactctctttattcacagacaatacaatcctgtatgtagaaaaatctgatatccacaaaataactgctagatctgataagttcatgaagcttgcaagataatcaatatacaagaataaattacattcctgtgtactagcaataaaaaattgaaaatgatactaagaaaataatttcattctttgtagcataaaatagattaaatggtcataaatttgaaaatataagtactaaacctgtactctgaaaactgtaatacattgctgagagaaattaaaaatctaaataaatgggaccatattccatgttcatgaattggaagactcaatactgataaggtagtgattctccccaacttgttctatagatttaatgcaatctccatcgacatcttagcagatgttggcacaaattgaaaaattgcacaatcttggcacaaattgaaaaattgatcccacaatttatatatagcaattcaaatgtaccaaatagccaaaacaattgtgaaaaagaagaaaaaagttagaggactttgaaatcaggacattacctgatttcaaatcttgatgtaaatctgcaatgatgaagacagtgtggtactgtcataaggacaggcttatagatcacctgtaggtttaggaaacaaacctattcatatttttttcttaaatctactaactgcactcctaatgttgacaatggaagagactcgatagtccagcaataaactcttatatttatggtcaatcaatatatgacaaaggtgacaagataatccaatagaagaaaagcttattattgggtagcttattgttagtgtacagaaacagagctgattgttaatacaactcaacaggaaaaaggcaaataacttgatttttaaaatatttaaatatatatttctccaaagaagacatagaaatggccaacaggtatgtgaaaaggtgctcagcatcactagtcatcagggaaatgcaaatcaaaacctctgtgagatgaacactatcatctcacccctgttaggatggctactataaaaacaaaccaaaaacaagagataagaaatgttgttgaggatgtgaggaaatcggaacgctagtacaccataggtggtaatggaaaaatgatgcagctgctatagaacacagtagaaaggttcttgaaaaagttaaaaatagaactaccatatgatccagcaacctcactcctgggtatatatcccaaagaattaaaaccagaatctcaaaaagatatctgcactctcatcttctctgaagcattattcacagtagccaagatatcaatacagcatagctgtgcatggaagaatgcatggataaagaaaatgtggtgtattcatacagggaatattatttggccttaaaagggaaggacgtcctgccatatttgacaatatgtatgaacctggaaggcattatgctaagtgaaataagccagtcaccaaagggcaaatactgaatgattccatttatatgaggtgtctgagacagtcaaactcgtagaaccagagagtagaatgatagtaaccaggggctgggcgaagggggaactgggagttgctgttcaatgagtataaagtttcagttatataatgtaaataagttctaaagatctgctgtacaacatagtgcctgtactgtgcacttaaattattattaagaggatatgtcttaagtgttcctaccataagaagaagaagaagaaggagaaggagaaagtgaagaagaagaaagaaaaaatgaagggggcatgagcaaacttttggagttgatgcatatacttggttaccttgattatggggatggtttcatggttgtatgcttatatcccaattcatcacattgtatacagatgctcctcaccttaggatgggattgtgtcctgataaacccatcataaattgaaaatgttatgagtcaaaagtacattttcaattaatgatattttcaacttacagtgagtatatccagatataaccccatcctcagtccaggattatactaaatgtgtatcgcttttgcaccatggtgaacttcaaaattgtaagtcaaaccatcgtagtcagtcggggaagatctgtttgttaattatggacccatcgtgtacaccttaaatacttaataaagctgttaaatgaaaattaaaagttgactgggcacatggctcatgcctgtcatctcagtgctttgggaggccaaggcaagaggattgcttgaggccaggagttcaagaccagcttgggcacatagcaacattccatctctacataaaattaaaaatgtagccgactgtggtgatgcaagcctgtagtcctagatgctcgggaggctgagttgggagaatttcttgagcccaggagttggaggttacagtgagctataatcatgctaccacaccccaggagaccctgtctcaaaataaataaatagaagctttaaaaaatattggtatctcagtgttcctcattatccactgtatttaaggtttagctacttgtgcttgatgcttgacaaggtaatcttacttttctccctgatattggtatgatgcaaatttactatatatatgacacaaatttatatatgcaatattttctcgttaatggccttttattttactctcattttcattatgctttgccttttaagtcatatagcaaataaattatgtggcattttcttagcaactattaattcaggagaatgggaacagaattctctcatagattcagctggaaggtaatgatggtcagctcccagtggagaaaaaaaaaaaaactcccttcagttttcgtaaacatacagagaaattttctcctaagtgctatgtcagtctgctgtatgtcctattgatctgagaaccagaaaacacatattttagtttacactgccttgactctattgtacatggctaggtctgtttaaaaaagaaatccttgaagataccctttggattctagtattttaaaacggatgcttagctaagtgaagtggtctacttcaaggatcaaaaccaatcttgagtaatctgttaggtagactccctaagttcatctgtaccttgtaccaaatttttaatgaatttagtaattgacatggatgtaaaataaataatacactaataaagttcatgcagaatcaaattttaatgcccagaggtaatgtagaagatattacctgtccatttctctggacttagctcctgcaactctccatttttctctctaaactttagccacactgaattcctagtttcaattcctctgactcgctaagtatttcttctaccttgataaaagctaattcctttgtcttgtaccatctgtattccggctgatattgacatagttttcagggctcaatttcaatgttacttactcagagggactcactgttacaaccaccacagccttttcaatctaagtaagatccactgctcttcttagaaacaggttatattccaaatgactgtaagtgcttttgttcttagaacatatgtctccattcaaaagaccgatagatattcagttaagccctttgagaaaattataaatgttgaggaccttgattattattgttattattgcttcttttctatgttttcccaggactctcaacaaatttgctttgcttttgtactcatggcacataatgagattaataatgtttagaaaacatttcaaaaatacacacagaggagacacatcttagtctaaagttagacatgataccaaaaactataataactatagctgaccagtgaccccatttattcatggaaagtaaaatttgatgcatatttgcctttaggagcaacatacctatgaaagttctgaaagtgaaagtttgtaaaaaaggagtactctcctaacaatcttaatttttttctatatatatgtatggtttgcattaaactcttttgtatgattagtggtttaatgttgatgtcacccatgacaccataagctacgtgtatggactggctctgttttgttcactcctgaatatccagcaaaaatagtatagtgcctggcccttggtagatgtgtaataaatgtttggtgaatgcatagctacacttcaatgcttatcgcattttaatcccagctactcggaggctgaggcaggagaatcgtttgaacccaggaggtggaggttgctgtgagccaagatcgcgccactgcaccccagcctgggtgacagagcgagactccatctcaaaaaataaaaacaataaaaaaaaggagacccattcatgtatctgtatcactgactagcctgtcaacattttgttaactacctcatcaagtagcaaaatcagtacctggtatgtggtagatgctcaaatatttgttgataaaatacagtaagttaatgacaggcgagcttgcctcagtgaaatataatctgtaagtgagcagtgtgtatatcatttgaaggtgccctacttagcctagcatatcacagagattcccagtaaatatttaggcagttcattaactctaaaagttgaccctcatagtcattggcctacattattcacctccctctgtctctaataaattcattggcaaatttctgaactccaactggaatgtttgtggtggatttcttcatacctaatggattatttcaattttcattttacattgtattatttacttgtctgaggtctttataatgacaaactcggcatgcatgataagctgtcattacttatgccagttgacaaggacatattatttttctacaaaaaaaattatcttggccaggcgcggtgcctcacgcctgtaatcccagcactctgggaggccgaggcgggcggatcacgaggtcaagagatcgagaccatcctggtgaacatggtgaaaccctgtctctgttaaaaatacaaaaaaaaaaaaaaaaaagcagaacaaaacaaaacaaacaaacaggagtggtggcgggcgcctgtagtcccagctactcgggaggctgaagcagaagaattgctcgaacccgggaggcagaggttgcagtgagccgagatcgcaccactgcactccagccgggcgacagagtgagactccgtctcaaaaaaaaaaaaaaaagtggtaattgttcaaaatatttacttattaattcattttaaaattgcatgttgaaataaaaaataaatgtttagtttttaaactatctcttctacaacagaaacaatatagtgagaagagtgatcttgttttacatttttgcaaatctctttaaaagttagcttaagagaaggcagctggttcttatatctgtttctgcattgaatgtgctgtcatatctcgcatcatgtagcctctgaaaaactcataatagaatgagagaggaaaaagtcaaataacatcttagtattattacgaaaataatttggacctcacagaaccactgcatgggtctcagggactcccaggggtccccagaccacatttaaggaaatactgtttcagggaatataactatttttgtacctcctgtggctatattcttttaaagaatagtaacctctgtttctgaggaacttagctgcaattatgtgcagagtttaaataagtgaaacggaaataccctttgcctttctgctcgagtatgaaagtgatgatcaaaatgttcccttttctctctctctctctctctctctctctctctctctctctctctctctctcactctctggggaacttcgggtttccgtctctatataatgtattcatattccactggaaacatacatagtttgagaaaacagatgacattttttctgggggtggaaagaattactaccacgaggaattcaaaatacagacacagtaataaaaatcaccataaagcccagaggggaaaaaaattgagtaacaaaataggaggtgaaattataaaactgagtaacaaaaaagaggtgaaattataaaataaatgataaagttggttgtgggttaggaagaaagagaaatataaagaaactggcataatgtaaaagccaagacaagaaaagtgaggcagaggcataggtcttttgactattttccatgtttgattctaaggtaagtagatatagtttctcatagttggaaatgttcgtgaatttaaacagaattaatgtttataatcagatgcaatgtctagtttttctatttgtcctgtgaaataataattgtgtaaagtgctcatgattgtttcaaggggtgaggagtagttctaattatcatagatattttcatgacttcgcataccactggtttatagagattatacagattttcttatatcagaactctcgtatctttaattccctagtagatgtctaagaaggagatttatcacatagcagatggtggtaaacttgagtaaagtgccagatactaaatgcctttggctttgtgggccattcaatctttgctgcaactactcaactctgctattgtagcatgaaagtaaccatagacaatatgtaaatgaatgagtgtagctctgttccagtaaaactttatttacaaaaacaggtggtgagcacaacttggttcatgagccatagtttacaaacacttgctgtatagctttccctggttgaatttcgttaattttatacagaacctgcctcccatacacacacactttgttcttcatggaaaatctccccagactactatgaaataatgttattacttggagatatacaattaagatgatgtcattaggagattattaatataggaactaagcaaatactatatgctaagtactgaggatagggtgcgatcacaatagatagaaaatctgcaatagtttgatgaacatgggaaattacagtatttcctgtgatggaaacattatgaggggctgtgggactacataacaggacctgtgacctatacctgggttggggatgtctaattaatcaaggaaagctttgtagaggaagtgatgtctaacctgagattggaaaggtcaacctggagctacctagatgaagatgtatggaaggacatcccaggcagagggaacattgtatgatgaatcctgatatggatatagtgctggattttaaggaagagtaagttgttccatgaactatacagtgcaaagaaagatgaagaaatagaagtagagaccagatcacaaagggctttttgaccatgttagagaagttatattttatcccattggcactaggatgttgttgagtatatgaggacatgatcagcaacatattttagaaagatctcttattctgaagtgtaaagagtggataagaaggagacaaggtaggaggcacgagctaattagaaagcagtctcagagaggctgttagaaatcagaacagaatggctattattaaaaagtcaaaaaacaacagatgatggtgaggcttcagagaaaagggaatgcttatacactgtttatgggaatgtaaatgagtttaggcactgtggagagcagtttgaaaatttctcaaagaacttaaaagagagctgccattcaacccagcaatctcattacttggtatatatttaaaagaacacgaatctttctaccaaagagacacatgtactcacatgttcgtcgcagcactatacagtaacaaagacatggaatcaacctaggtgcccaccagtggtggattgaatgaaataaacgtggtatacatgcaccatggaatactacacagtcataaaaagcatacagtcacgccttttgtaggaacatggatgcagctggaggtcattatcctaagtgaattaatgcaggaacagaaaaccgaagatagttagaagctaaacattgggtactcattataaaggtgaaaacaatagacattggggactactagaagggggaggaaggagaggggcaagggttgaaaaactacctatcgggtactatgctcactacctgtgtgtggtgggatcatttttaccctaaaccttggcatcacacaacatactcaggtaacaaacctgtacgtatactacctggatcaaaaataaaagttgaaatcagaatgagaaggagcgaaggagacagcgacaggaggatggagagaagtgggcagattcaagagagatttctcaagtggacttatgaggacatgcttattgatacgctctgggagtgagggagagagaagaatcaaggatgacttctacactttcagcttaaaaaaccgggagctggtggagtcatccattgaacttgacagaggagcacgtttaggcaggaagatgatggtgtttgaatgtctgcgaagggaaaaactgaactgggattcaaatcagaaaaaacggtttgaagtcataccctcttaattgcattttctatcggatggtaatggctttgtgacaggctttactgataggtgatgtaactctgcctctgacagatgaagatccaaagcatcctcagattttcccgaagcctgtttcagcaactgtgtagacagcacacacaaaaatctggggggaagtcctagggctcagttagttgattggatctattaaagtagcattggagaacacagttcagtctgagatttcccaaacatattgctctataatttatttttacccagaaactgaattcgatgtgggatagggattataaaagccttcagattccagatagaatctctgaatagaaggcttttgggccacatctagtaatctcctttcctcactccatttctgaacttcttgttcacttcttcgctgtttttaggacgttcttactacactcctgcctcaaggcctttgtacttgttttctctgcttagggcgttctttcccgcaatatttgcatggcctcctccctcgcttctttatttctatattacctatctttattaaagctgctataaaaaaaaaaaagcccacacctcagtggcttaacataatagaaactttccgttcatgcaaactttacaaaaattttctggtcaacaagtagatttcctccaaatggtggatcaggggggcccagggcacttcgcttttgtggctctgatgtctttaacatacggatttcaaaatcactgtgctcttgtacataagaatgaaaaagaacaaggaatattacatatgtggtggtggttattggaggtggggttatgagccaggcttcatattcatgagcatcacttttgctcacactccattggctcgaactcagtcatgtagccaaactaatggcaagggagactgggaaatgacagctagctgcacaattaagagaaatgagtagacttgtctaatgagcagctagccagtccctaccacgaggactttgctcaaatgtctccttctccatggaaccttctatgatcaccctttataaaatcacaactgctccccatcttcccctcaatatttccatcccttttccatgcttcatttttttcctctgtaacacttactgtatcacaatctatagattttatttctttatcttgtttactgtctgcctccccttcctcccaatcggatgtaaggtccatgaggcagggattgctgccgatattcacggccatatcaatggacactagtagaccctcaataaatggctgttgcattgtgattacatatatgcttcacctagaagtagtctcatctggtggcacatttactcatagattgacattaattctctattgttttttccccagcaaaatttgtcaaggtagtttgtcagtagggagaaataaagttgtcaggtggctcatcaaaagttcaattttgagtactcctcctgtgtactcataatgttttataaatacttttatctatgtaagcacgtgggcttagacacaattctaggattaaaacagaaagctctgtatccatattttcccttttttgtacctccttttatgttctctaccattttttttgagtgctgttagtgaagcactaggctaaatcttgggtttctgcaaaaaaaactttaatcctcacaacactctaaaatgtttattgttctaattttaagacgaggaaactgagggctaaagagattaaggaactcgcccgtgttcacgtactcagctgataactggcagcatttagatttggacttactttccatacagatattcgcattgctaaccttcaggtttttccctcatcgttttccacatctactcaaaagttgctaatcatttccttaatagtgaggcataaatgactgagaaatcttgatatattatccccctcaggagcacttcattccgacaagacacaaactttagggaaaatgaacaaatgtctacttgtacaactcaagcaccaaccaggtatggtagacatgttggcttaaaaataaagttgatgcttgggttctgattctgataatgacctacggagggtatggcctgaggaggttactaggtgtgtgtagaaatcaatgttttgttttggttttccctcgggaagggtcaacttatacttgaatccttctgaagtttctcaaattacaagatggtcatttattttacttcaatcaaaacaacaaagtactgtccgggaaagatgtattgccttgacttattctcaatttatgcttattttggaggcttgtagaagtaaacctgatagaggagggcaaaaacacacacacacagacacacacacactgggagaaaataaatttaacacagtttagggattgactttggttgtatgacatcacaattgcaagagttggatgccattgtaaacaagctatggaaagaatactgttaaaagtaactcattaagtggttacatggtgtagctcatggacatatggcacagaaaaaagataaagctgtctttacataacataaaactgtattctgttatgtaaatgtgtgcttgtggcttgcagtaaaattcctagtgaaacattacctctagattcagcagtactatacctcaggccacatggatgtaagtaaagatgatgccctctggaaaactgagttaggcaacaacaagtgcatccatgaggatgcaaatttcaatgttgaaggtgcctgtgaagaatttgaacaaaattgttgcatgaaatatgaatgaagaagtgtgatctaatgacataatattttgtactatataattttaaagtagtacacacaatcaaattaatgaattaaacattatatgtaaacaggtgatcattgtatctccattttctaaagtttctatgttaaaggtgatcaaaaaacttggagagagggacttctcatttggaaaatgggatagtcacctttgggtatgtgatgtatcaatctctagaacttcagtttcttcattgaaagcatataaaaggcaatccaaaggatgtatggaatattaaaagattccactgtgaaactatctagcactttacctgaaacacttgttagatcccctcaccaaaatcatgccatgtgatttggcagtctattcctcttagcgtaagagtagcccgacagaaaatgttcattaagagttaatgttaaattcattgaatttagcaacacatgagtagcgcttcctttctgattatgcaaatctctcaccatcgtaatacgtgcttcctttaatttcattgggaacatttgtaatgtaaatggtaacagagccaatatttcaaacagaagccattctttctaaaaaaagctaaatgtctaaatgtattgaaatgcttctaaaagtaaaatatttagcacttatttgcagatgggtaatgttaaatatctcactcattattattactaccacttgtctgaataaatcctcccataagcattaagcaagtaggtaaacaaagaaataacacttcatgtgatgaatgccaatatgaagcacgtttaaactgttctgtcaagagacaagcctggaaatgctaactgtgtttctttgcttttctgcaatcatctgaatacataaattcaaattgcagcttttaaaacttcaaatcgaggcttttgaaatttcagaaaacacatgcgcttggaaaagcagattataacaaggtcccaacgggattttgtcaccatcttttttatatttcaaagtataaaaaaaatctagataagaaatgactaccaaatgttttcatatttaaaagatgctgtttttttaaaaaattaaatcactggaaaaaaagttttccacaaatatcgtgtaaaaagaaagacagcaaaaagcttagccaaagcttttactgtttaagtgatgatttattctgagagttcttaagagttttctaaattagtatatggttaatatccataaaatcatatgcaagatgctgtctttcaaattgatgctgaaggttaattataaaatgtacttaattatttatagtgtcccattgagtcccagatactctgtgtccaagaacactgtaaatacagaaagtttagcagaattatattggaaaggcagtaattcttcacaaattaacttattgatataatgcaatcccatttaaaaattttcagcgagaattgttttataatttgactgaatgatacattacataagttagaataactaaagtgggagagcgggttaacctaccagaaattaaacatattttaaagctgcaataattgacatagtgcattactgtcacaaaaatctacagtagatcaacaagcagaaacttaaaatatcatgaagaaagcaccataaatcaattcagaagagatggtgctgggggaaaaaatatcagtttctgaaaaactcttcaaggttagaaacaacactatataaatttaagatggattaaatatttggttgttcttttttaacaaatgaaagagtaaaggatcaagaataaatgagaatatctgaacaatggtaaaatggccacaattttaaggatactatcaatgaacataatatcaaagaaataaactgttaaattttatttagaaaaaactactaaaaggcaaaaaggaagctggaaacgtagtctcaattaatctatgtttcagataatgtgaaaagagctcttaaaaataggaaaacacaggaaaaatgggcaacagacattgccgataattgacagtggaaactaaataaatgacaaacatgtacacacatacaacattttcaactttcctattagtagaatacttaaaatatctatggcaagctttttatttgttttattggtatatcaattataatgctcaatagtggcaaaagtgtagtgagacaagtattttgtaactgttggtgggagtttacgagtgttctgagtaccaaccttgacagaaattcaacaatgtgtatctaaatccttaggattcccattgttaacttttcattctcattccagcagatacatgattcaaaatgtataaataaatgtgtttattgtagggttattcattataataaaaaatgaaagcaaacaaaattcctaataacacaataatggtgaaatatagggtacccctatatatcttattactaggatcttaaaaaatcaagtttttaaagcgtaattaatgacctacagagacacatagtagaataataaatgaagaaaataagcatacaatatagggtttgaacccagtaatacatataaatctcaactatgatgaataagcacaacatctctcctctgtactggatattcttgatagaaaaaaatatgctagtaaataatttgagacatatttgaaaagaggggagtgtttgatttagaattttctaaacttgagggttattattatttttttggtttgatattactttttcctgctccttaaatttttgtttgtttggggggtttggggttttcttttccttaaacgtgtctgcttctagatgaaagttgaaaatgtttaaaagccttgccaatgtgtctaggtttttcaaatgtaatcagattttagcaagattttacttaactaaaagtattcagaacactgtgcaaaatcatctggagtcaaatagtaatggaggcaatgatttgcagagtagaaacagagagagagaaaaagatgagatagaccctcaaaatctagacccaaggaattaaatctgcttggaacatttaaacaaataaaggatgcctgtactatactagacgttttcttcttccacaattgattctaaggtcagaatctgaggggaaatggtgctgttccacattctaaaacaaactgccagcaatcgagaccagccacttccccatagggtttactctaaagcaacagggattattatctctattccaagcaatttccaatctcctctgtactccgtgtcccaggcaagattaaaaagactcaggtaggaaggggtagtaagctttgtggggagtgcagtttgtggtaagggacagttccttctctttcatctctctgagtcagaagtagagacttcgagagaatcactgagagtaagtatgtagactccaagaaggaaaaagcatcctctcacttcaatgaatgtttggaatctgcagacctccttcccaggtctgtgtagcttttggagaggccagaagagcaccgtaggcattcctttggctttccatggccaagcacatagagtagaagaagaggaggaaccgtaaggttaaccatacataagaaatcaacaaaaggctttgaaattgacttttcctatttttcaatttaaataagagagaattgtcaatgattaaaattcataaaacgaagaaagaatggactcagaaaatagcaaacatgaaatgttaattattagttcaaaagttagtttaccgtgttttctctgccaactgattgctaatgactaaagtccttatttccagctttcctctctccccgagctccagatctcttgatttattaaactagtagtttccccaaaatatatgagacaacaaaatatactctcagctgaagtaaatagcattcatcttcccagtcagataaggcagaagtacttctagatcagatgttatattcgggataggttaaaaacagaccctgctcccagtgtcccaggaatgaacagtggatgtgcttatttctcattgcatgcgtgtatcaaaatatctcacgtaccctacaagtacatacacttactatgtccctacaaaaattaaaaacaataaatcataaacatttgtaaaaataagcgaataaatgtataaatgaatttaaaagagaatagacagaggggagaatgtaactttacgtgtcccagaacagactttgaacaggctcttatcatataggaaaactgaatgaatatatgcaagcataagtccaataaccagattctgatttacagaatgatcgcaactgtagttctctcaaggccctgtctttgaacaggctgtgtcttattcctgcaacatgctgatctatcttcatgcttcaagactcagatcattatcttctctgggatgtctcccaagcactgccccagaaataacttctcctcctataatacttaatcataatccttggcttacatgcttgtttcttctcattgactatgaaatcctcaagacaaggtatataacgtatatatctttaatcctaatgcccaattgagctcttagaaggtagtaagctcccaatacacatttgttaatttgaagcaaaaaaaaaaaaatagctaatcattcaaaaaactgaattatcacaaatgtccatctaaagtactatatttacacaattaaatgctatacagccaggttaatgaacagactaaaattatatgcaacatggattatcgtaaacataattttgaatgaaaaaggcgagacacaaaggagtataaagccatacaattccattttcataatattcagtaccggcaaaataatcaaagttgacagggtactggttatacttggaggcagtgactgcaaagggataagaggagatttctgagattctgataatattctatttccttctctggttgtacagtgtgttcaatttttaaaacactattgggctatacagttaaattgtgcagtgtcctgtacgtatattacacttcagttaaaagcttccatggaagctacacatagttcccaaaagacaacaaaacaaaaaattttcaattattttaagcacaaacaattttgttcagctgtcttacaatcgaatatgtaagaataaatttatggctaattagcatagagttatatgcattttcataattaaaacttccacgagtacaacatatgttaagtattttaaatcagtttttctctttcctcaaataaggttgtgagtcataattcggaaaacagtttagcatgtaataatttagtgttttattttaaaccaagctgaagccacataaagcagaactgctcaactgagccctatccaaatccttgacccacagaataagaagcagataaaatggctgctacttaaacaaaacaaaaaccttgtttatatttttgtcctctcattttccataagtatactttaattaaacattttaaaacttgtaactttaggttatatacttactttagttggttctcaaccagggacaattttgtccccacccccaaccccccagcatatttggcagtgccttgaaacatatttggttgtcacagctcaggggcgaggtgttactactggtatccagtgtgttcaacaggccagggatactgctaaataccctacaatgcagaggatagctgctcacagcaaagaattttccaaacctaaatgttagtaatgctaaagttgagaaaccttgctcagatataatgacataatgttgttagaatttttattttattcattttaatgtatgtatgtatgtatgtatgtacgtacgtatgtatgtatgtatttgagatggagtctttctctgttgcccggggtggagtgcagtggcacgatctcggcttactgcagcctctgccttccacgttcaagtgattctcctgcctcagcctccctagtagctgggattacaggcgcctgccaccaaacctggcaaatttttgtatttttagtgtagacggggtttcaccatatttgccaggctggtcgcaaactcctgacctcaagtgatccgcccacatcggcctccctaagcgctagggttacaggcatgagccactgcgcctggccaggaatttttgaatcagaatttttcttgttcgattttaatctcttatcatttagagattcttgaaatattgaaattactttgttcaaagtgaatgaattttcttaaattatgtatggttaacatcttttaaattgcttatttttaaattgccatgtttgtgtcccagtttgcattaacaaatagtttgagaactatgttggaaaaaaaaataacaattttattcttctttctccaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaaggtaattttattttctcaaatcccccagggcctgcttgcataaagaagtatatgaatctattttttaattcaatcattggttttctgcccattaggttattcatagttccttgctaaagtgtttttctcacaactttatttcttcttaaccctgcagttctgaaccagtgcacataagaacatatgtatatatgtgtgtgtgtgtatttatatatacacacacacatattgcatctatacatctacacatatagatgtatagattcaatatgtctaaatgtatataattcacagtttttatctttgatttgaaattaattttagattttacttgagaacttcacaacttcatataattttaaaaactgaagaccagattgtggaatcataaaatctaaatctaaatgggaatcacttttttaatctgtcctggttacctacctggagatttgagaagagtctttaaaaagaagaatccattttcttagggaagatctggattgccagatcagtctcaccacttcagcctctacttaaaggcattatattcccccgaagcaatgttttgttttagctgatttgtctgggggtgtgggacgtggtgttggttcacattccatttggttgaatagacatccagcttattccagtggcttttcataccgtcctactgtgatgtctgcttattactgattacttcccttggctgactgacatgctctgattgtgcaattggattaactttcatggttttagttttaggaaagcagctcttttggatctatttcattttagttgtcaagcagaaggtgaaaggggaagagaaattaatatttaatcattccctgttatgtgccaagtattagatacatttacagccactattttatttaatcttcatatcagattttgacaatggttgctattatcctcattttacacggtcacataatcaaagggaaatgaaattggtcctttatcaatgattcaggtgctttacacatgtaaattagagtccaatgtcaaacgtttatttctgtgaaacaagaggtttacacctgaacaagaaataaagtataaaaataaaatatggcgtaattcaataaacaaatatggagcactgactatacatccgatgttttactaggtatttgggattcaaaaatagaaaagagtgggaatcatttgaagatggttataccctagaacaatgaactcagtcttttcttggaaatttatctttcccaaatgtattgagtgtcatatatagtaatataattgataattcattcgaaacatatttagtggcattttcttattaattaatatgcatgagtctattttctcctgaaagaatctagatcagtgctttcaaatagaactcccgtgatgatgaaaatattctgcatcatccatttttgtaacgactagctatttgtgccttttgaatacctggagagttggtcgtgtgactgaggaacttgagattttattttagtgaattttgattaacttgaatgttaatagcgttgtatggctaatgggtactgtagcagacacagtaactttagttgacaaaaatgaagtgttaacaccatggtgattttggaggtcttgggaaagggcatacactatgtggtggtgaatgagttcgagaaatttagggatatgaagtaaaaaatgaggactccagaatgaaactacccaaatttgaaccacacctttgttgcttgctagatttgtgtcctgggagctggtatttaacccctttgtctcagtttccttccatataaaatgaagataattggatctacctgatataattattataatatgaagataaactaagataataaatgtgaaaaggttagcacagtgcctggcactgtgtatattgagagtcaatactctcaatgtcagttacctcttaagatgataatgcaatttctcagcagcaagctacggtatgctatggcatgctatgatacccaagaggctgatgaatttgttcacattgttctatttctgatagagagataggttttcagacactaactttatttggagtgttgctttaccatctcacatttttctcttaaaaaatttatgagggataatataatcgtttattttctacagagatttatctactgagggggtgagtgtttcagtcaatcagctctgtgctcagatagaaaactgttggtatttgaggtaccactgggccctcggtcaagtcgcttcattttgatagactaatcaatagaagcaaagacaaggtagttggaattgtgctgtaattcattttaaacgttgttgcatttgtctgtttcagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggttagacattaaccatctcttccgtcacatgtgttaaatgttgcaagtatttgtatgtattttgtttcctgggtgcttcattggtcggggaggaggctggtatgtggattgttgttttgttttgtttttttaacctgaccgtttgctttggctatatgttttgttgtggctagaaaaaatgatgatggtgaatggctttacattaatgaccaaatgccaaaatttataccacaattttttgcataaattattctgaagaatcagactgaagaaatggcgaagtatttaattcagtggccaggcatgtactgacagtatttaagctgaaaggacgtggtctggttctagttaaacaagtgtcataaatcaaaattaattattcacacctgtggtatggacttaataattaatgtacactaacgttcgccacaagtttatttatttacttacctactgatttattaacttgtgagttttcatctttccaccttgcatactatataaatctaacagtaatactatttattaaattaatacatatttattttatataaagcaagtggtacatatgaatttatagtaaaaagcaacatcaattgatccagcactattcattcaaagacaatcatttccccactgtattttcatggcatctttgtcataaatcaagagaacttgtatgtatgaatctgcttctggattctgtatcctcttccatttgattaaatctgtactttaacaacagtacttcactggcttaattacaatcttttttttaaaacaatcctaccgagctataattcacataccattaaactcatttaaagtgaacaattcaatcgtatttcggtgttacttttttaaggtgtgataaaatatataacataaaaaattgtcattttagtcatttcgtgtgtccagctcagtggcatttattacaaccatcaccacagtttatgccccacccccaatttttttttttcttttttggagacagagtctcgctgtgtcgctcaggctggagtgcagtggcgcgatctcggctcactgcaacttccgcctcccaggttcaagtggttctcctgcctcagcctccctagtagctgggattacaggcacctgccagcatgcccagctaagtttttgtatttttagtagagatggggttttgccatgttggccaggctggtctcaaactcctgacctcaggtgatccgcccaccttggactcccaaagtcctgggattacagcgtgagccaccgcgcccagcctccaaaattttttattactccaaccagacagtctgtaaccattaagcaatagttcccctttctctctcttcccatccgctagtagcctctggactactttctgtttctatgaatttggctattctagatcttttatataattggaattatatatttgccactttgtgtctgccttacttccctcagcataatattttcaaggttcatctatgttgtagcatgtgtcagaacttcattcctttttatgactgaataatattccattgtatgtatatacgcaatcattttatttaaacattttggatctggttgtgtaaaccttccactttgttcttcctattcaagattgccttggctacttttggttctttgaataaattttagaactatattgtctatttttacataaagccttccaggatattgattgaaattttgtgaatctggagctcagtcaacatctttacgatactgagtcatctaatttgtgaacattttgaattgtgtcaggttatttattgtattttttaaattggtgatgctgacattctaataacagatcatttacacgactgataaaatatttaggaactaaaataagtaccaattttatgacattaaaaccataatgtgcgcttaagtgtctctatttcaagcaggtagttatttgaaaaaaaaaaatcccttcttggtttctacctttaatgattgcaaaacatctgtgtaaagatacagacttttatgtatggagggaaggtggtgtcccagcaattaaattttatagctacataacaatacaaatgaaatcatccctcataaaaagagaacaaggaggaaggatacccaaaatgttctacaatatctcagtacatcttatgacaaaaagaagaacaaaaattataattgtaggaaatgtgagagaactatctaaaatatacaatagcagctttgtgggttgtgaaagagtcaaggttttatgtgtcctgcaacagaataaaaagtcaaatttttatgatagaaaattaaaactgaggttacgaacaccatcatgtatagacttatattactacagcatccataatatctgtttcctatgccaaaattataattttaatgcaatgtctttgccattaaatgccacaggatttggaattttattcattagtcatattaaaattatttaatcatcttttctccatccatatgcctctgtatccctgttagtttagatttagggatagaaagcaaatgatcagtaccagatttaggtaaataacacaagtttttttaaaagtaaaagaaaatggcttataacactggcagacagtcttgatcttcattaaatctcaagctcttacttattacaggagggtagaaataaagcggaccccctccctgtgtcctccagccctacccttcatccaaaggttagagtgggtgatataattggaactagtgggtcatagttactgtgacatgaatatgtcaattccttagtacatagtatctccaaacatatcctaatatcataatcagttggcaggtgactttctccacagctaactctaatatgctgcattctgcgtattgagccaactgaccccttactcttgtacctttattttatttttttttttatttattttttgagacagagtctcgctttgtcatccaggctgcagtgcagtggcacgatctcagctcactgcaacctccacctcccgggttcaagtgattcttctgcctcagcctctcgagtagctgggactacaggcgcgcaccaccacacccaactaatttttgtatttttagtagagatggagggttcgccatgtcggccaggctggtctcgaactcctgacctcatgatctgctcacctcagcctccgaaagtgcggggattacaggtgtgagccaccgcgcccggcctgtacatttatatttcattactgaagagagaaaacagcaggtgaagataatatagctatttctttaagggagtggtggacagggttgctttaaactgaatatagccattagcgtaaatttatgggtagcttcatgcaatgaaggctcatgaaatgatatcctcattcttgtctaatacataacttgaccttttacagcctttaacaatgatacccgtaagagccacaaagtggggatgttattaaagctagcctctgtgttcctctctctgatcatctcattctatgatcttcacccacacttctgactcaggtgtttttaatatttatccctcttcatatttctttgtattttctctgaacatgcatgtgggtgtaggaggctctctcgccatcatcatcactctcttcctctgtgtttctcacttttaggctaattttcatctatgaattgacacgtatattataggaatttatttttatatatttattaggaatcttctttttgttttttttttttttttgagacagagttttgctctgtcgcccaggctggagtgcaatggcacgatctccactcactgcaacctctgtctcctgggttcaagcgattctcctgcctcagcttcccgagtagctgggattacaggcatgcaccaccacgcctggctaatttttgtattttaagtagagacggggtttcaccacgttgatcaggctggtcttaaactcccgacctcaggtgatctgcccacctcggcctcccaaattgctgatattacaggcgtgagccaccgcacctggccatgaatctacttttctatttgcatatttgccactctttttctgccccagttgtttatgtaacacattctcttctgctctccttccctgaccccgttaatcccagtttcatctctttcatgtctttttattttgtgtcccctttcctcattcttcattgctctttgtatatgttatatgtgggtatttttttaactacccatttatttaaaaccaaaatatgctttatcattctttatttttgaacaccgagtcctagaaaggttatgtgacttatttgagaccatgtagctttctatttaaatataaaagtgattccaaaataaacagtaggggttttaaccttttggtgaagctcaagtgatttttatgtggataatatcctaatattaaaatggggatttattttcttttaaaaaaactatatgagtttttgctttggtttttgccctttttgagaactagatgctgtgttttaaaattactttctagaaccttctctgctgtggaacatttacagttgtgtaatatagcaaaacatgtttatgttgtttcagaattagttaaaatcctactatttttaatgtcaagtaattttacaggtggtgtacgttatgcattcctattagttttaataaatatgttgtcattttgttaaataagtttaaatttttcatcgcattttacatgtaaacagtaatttactatctacacataaaataccatttacaaataagatatactgtttatatgtaaatggtaaattactatttgaatttgttactgcccagacagtataaaatggtgcacataaagaaaaaagcattttggaaaacaattaagaaatttggctggaaagtgaattttagttaagtgcatcttattcactttaccgaggaaaaaggtaggtttacaaatacaacatatataacaaacctttaatatgggaataatttttgtaatattgataataatacaggtattattttcaaaaaatcaccaaataaaaattatgaaagtaaaaatacagtgcaactcctagcacaaactatcttccacaatatacagttggctgtatctaaatttccagaaatctggttcattttgtattaatctctaatcatgttgcttctaaatatgtatctgaggagtaaacatttcagatttattttcatttgtataaggtaaatgaatgtttagtctttttccagacgtatttgctatgtaatgacagtcattattagtcgtcagtataaatgtgaatagcaaaaaggagaaaattaaataaagctagagcttggctttccgactccttgctcaaaaatggacactttgtccaatcaatttcctatcacaagatgacgattaatagattgttctaatagttaccattcagtcctgcccttaacgtgatgttttttcaaccaaataatagaatcttcactggcattgttaccatattgactggtatttatggaaccccggaaaaaaaaatgctgtaaaatatatagtaggaagtataataatcattataggaaatcatttctctagctggaagtcttagcagggaccagatagttccactggagcttttatgtgctcatgattttctcccttgaagtgtatttgtaacacagttcacacagtttttaattttataaatctgtgtgctaaaacgctattatataagaaaacgggccgggtgtggtggctcacgcctgtaatcccagcactttgggaggcccaggcgggcagatcacaaggtcaggagatcgagaccatcccagccaacatggcaaaactccgtctctattaaaaatacaaaaattagctgagcgtggtggcatgtgtctgtaatcccagctatttgggaggctgaggcaggagaatcacttgaaccagggagtaggaggttgcagtgagccaagatcatgccgctatactccagcctggcgacagagcaagactctatctcaaaaaaaaaaaaaaaaaaaaaagggtgttcacctatttattgggcatatagtctgatagttcccagaaacccattatcttgaatgttttctttatgtaagttcctggaaatccattatttggatgttttctttatgtagttaataattacagcaaagctgtaattaaattatttattcaagagctatctattaaaggactactatgtgccacattctgttctaagcatatcataatcacttcccacccttcccttatttaaaggacatgcataattttatagggcttggcattataaatattcatatctctaatttatagttgctaaacagtttgaagctgagggttgggggaagggagtagtaatttaaagtttataacataagcatccttgactttgcctcctataatttcacactgacatgaggtttattactaggttgtgtgtcatgagtacatctcaatttgctctgactgttctggtttttgcctgttatcctatcataatttttaatagctccctctttcattgtcataagtattccactttagaagataaaatatatagagagggtcactctagttatgagaacaaacatcaggcttttagagctaggcttggtccagtgctcaataactattattatcatgattgcttttgttcttagtagcatcatcgtccttgtcatcatcatctaccttcctaatactttagttcagctgagaatttcggcctatccaagaaatctgattgccattattaccgaattaatcactctttaatgacaatagtatataagaatacgtgacatttaactttccaaattattgaaatgttacgctgtgtatggaaaattctttctaaccgtgttttttctctactctcaaatcgtaacaatcgtcaacacagaagaagacttttatgaccaaatttgtggaatttttttccccatacaccaaacagcaggcaccagctgggtgtctctaattcagtcctgacactatccacccagagatagtgtcagatcccatagattgagggctcagtaccgaggtctgcctcctctgcacccccctagcgcacgcgcgcgcacacacacacacacacacacacacacacaccagtctcaagtccaggcctctggaacttctgacccatgggcttcaagttggggttcccatgaccctctctttgggttcaactaacttgctggagcagctcacagaactcaggaaaacactcgctttcacctgtttatgataaaggatattgcaaaggacacagatgaagagatgcatagggtgaggtatggttggggtggagggacggaaaggggcatggagcttccatgccctccctgagtgcaccaccctctaggaatccccacctgttcagctacccggaagctcactggactctgtcctctttgttttttatggaagcttcatgacatcagcattccttccccaagggtatatggtgggaccctctaacaggaggtttttaagacctataatctgaaaggcgagggaacattaaagtgaaaggagagcaggagaaggtcagaggcctgcccctgagacccaacgcaaccaacattataacaaaaaactgtaacaagggctatgggtgttatgagccaggaacctggatagaaaccagtatgtactataataccatataggcaatgccaagaatatggatcagacactttacaaacaaggaaaaagtaaacaggagtgatgaggaggtaatttactgcaggcattaatgatgagattatgaattatggattccacttgctaccagctatgtgatcttatacctactctgtccatacctaagttataacatccataaaattcaaatactaaaagaagacacttccccaggttgtggtgaaaattcaatgaggtagtaaatgggaaatgtgtaacacagtatctggcatattgtaattgctcaaaaaatgttagattaaaaacagtaggagtaatactaaaatagaaaaatgcaaagagcaagcacaaaatcatctctgattctcacctccaaattctccaaaagtctcaccttcttaatcaaagttgtaaatatggctcttggggagaaagctgaactatgtgctactattatgaatgcaacaggtgaaggagaggagagttagaggcagcaagacaaccaaatggctctcgtggaaggcacagaggattttcagccactgctctcctattccgctgatattactttcattttctatgaccaactagcatttcagctaaaatgtgttggaaaatgatagatttttctcctcctattgcctaagaagcccaacaaagccagcattgttttcaaacaccagcattctcacttttaaagtatgaacataattcagaggacttttaattctgaacatcgtttttatcaatctattggcctgattgtaacccagaaatccaagcagaaagcaagtaaactttcacactgcttccccatcccttccccctacctttatttttgacatcagtttccctcattttggcaaagtaaaggaaaagcatttgtagaaggttacactgaagctagataattttctattaggaaacctcaccaaatacaagataatttgttcattccaatataataatgttttaaaaaatataacaaaaatccagcataaattgtgaagcactgatacttgtgtaacaactaatttccatagtgaaacttcattgttgccactatctacatactgaaaatgtatatcaagcatgtaaatgtgtcacttaagtatgctgtgccctagattttatttaaaagttaagctaattttcaactaaaaacaaattcgactattcttagcaatctctcctccccgttcatgatggatttaaaatgatgaagagtataaatgatgatgaaaagagaaaggaggagaaaaatttcataactctgcatcttcagtgtagcatttttaagtaactcctttattagcacaaaggtgtttgcctgaagcaatgacttctagaaaggagaagaaatgacataataaaaggggattttgctaatataaaatgttttttctttccttttgtttctgcaatgcttttacttacatagcaccaaccctgagactagagggagtttccttcctttctaataatttaataatcgtgaaatgatattaaatggaagttttcatatgccaactccttaaactgaggttaaataaggaacaaagattaaaggccatatttaagaccacatattgtaaattctaacccagtttcatttattatatcacctgcaaagccaatatgccatacaaaagtaaaataacagggtgatttttattaaagatcagaatcataccaaaaatgaacttttctgtcaaatctttatactcatacatcaagatgtgagtttatttatgtagctaaaataacttaatactaaatgctgactactatattcatgtcagctgacccctagtgcttcaaaccatagaaaagggataccaaatgctgggttggttgtgtattccatttttgccgtataccacctgccaaggcttataacagatctgtaatgggtttcttaccttttattgtgtagaaaatggattgttggattaggcctggggccagtgaaccatggaaccccaggtttgcaagaaagagtttatcaccctttgatgttatttctgtctcgtgtcagctgagaaggatgagctagattatctgaaagtaagctggatgccaaaatcagcattcccctcatttatccaccttatggttcggggcaagaccactgtatgggtaacaaaagggctgataagggcctgatggagaaatttggtttttctcccttttgattggcttgctgatattagaaccaattacaagacattgacgagagcatttcattgtttgttgctagagaaaatccatcaattttgttgtggaaatgaaagcatttgagctgaatgttgcacttataatttgtgaacattttcagttatcaccgggacaagtatagtccatctttggcatggttggccaagtgtggtgggaaaagagatggaccagcaaatgggccggaaaccaaagtcatcaaaagggtatttcaagaaaactctatttgttctgatggttacattctgcaggcaacctgtgactgatgactgatgcttatacctcaaatgcagtctaaaaatatttttttgtgaaagtgacacattctgactgtgatgtgggtgacatcaacagttttgaataggacagtacttcttggacttattgaaacttttataaaagaatgaacattctgaactcaattgcaatgtaaatgactatcatgaagattgcttctgttggtgctatgacttttgtgacaaattttagaccattgcagttatctcctagaggttgctttattgttttattttcatcagtgatgtgtattttatcagtgatgttagaatcactgagctgctggttaaggaagagaaaaaaattaatattcaggtgctatataggcccttattcattgagaacaaataaaggccaacacacaaaacaggaaaattaatagaaaagacactctatgggtaagatttcatatagtttgggagcagacaaaaactattttaattactaaaataattaagaaagatgttgaggctgggcacggtggctcacgcctgtaatcccagcactttgggaggccaaggagggcaggccacttgaggtcagagttcaagaccagcctggccaacattgtcaaaccctgtctctactaaaaatacaaaaattagctgggcgtggtggcacatgacttgaatcacagctacttgggaggctgaggcaggagaatcatttgaacccaggaggcggaggttgcagtgaaaggagatcacgccactgcattccagcctgggcaaccgagtgagactctgtctcaaacaaacaaaaaaaaaaagattaaaaaaaaagatgttgacattaacatgttcaagtctttatgctgaaactagaatgcagtatgattaaataatcatttctacttcgggtgaaggattagttttcttaaagatacccctttccagcttctcagttcgcgtgtggttaattcccaacgtggcctcaaatattctaatggtttgtgtaatgagtgccaccgttccaccttcttattctccatgcctcatctcagtcctggaaagatcactaaacttgcagttcataactcagtctagacccaggttcaacactcactaactcataactgtgggccacttatttaaatctcttagtgcctctagttcctcatttgtccaacagtgatgcattatgaagcatgtttgcccatctcccagcgtctagtgaggaactaaaaacacaatatatactatcatactttattacgaggagttaaattgtggttactattacaaagtaggttaccataaaattctaatagcagtggtaaggggtaaagatccacgtgccatcacgtagagcagaacttctcaaactttaatgtacggcaggtccttgaataatgttgtttcattgagcatcactgtgttataatattggcaagggaaaaaactgtatctcagctaggggggcactgtctatgtggggttttcttttgtctctgtgggttttcttctagtactctggtttcctcacatgtcccaaactgtgcacgttaggggaattggtgtgtctacattgtccccatgtgagtgtttatgtgtctacgactgtgccctgcgatagaatggcatccctgccagtgttggctcctgtctggtgctctgagttgccaggatgggctctggcctcccaagtccctgaactggaatacgtggcttggaaaatgaatgactgaattaatataaattactgtgaaataaaaattcatatagtattcaataatcataaagatgcgtgacaataattgatgctctacagaagtgctcagtgagctgccatattgattattgtttgtttttgaactttgtggtgagagaaggcaatcctggcagtttatgctttgcaaacatttattccttgaatgaaccaccgccactgcaaacactgtcactcactgattcaccaaaaactgggtaaataattttcctcctggtttttattaatctttctaaagtggatgtatatctcacatttatttctgagtttaatattagaagtgcttggggtctttatttagatgttggatcatgttttgtgaacacaggtatgcagtaggaacttaattcttgtttatcaattagcctatggtaagattggtttcattatatgtcattttgcctaagtcacagtttcccagaatctatcaacaacattaattgatgacttactgaaacaggaatcaccttgagatcttgttaaaatcaggttactgattcaatggctcttgcataggacctgaggttctgcatttccccccctaatttcaagatgctggttccctggtccccttgctctacttcttaaatggtagggaggtagagagtggctatcaagagtctgtgtaggagttgaccaccaatcccattcaatggaatgcatacagtgtgttctgagatactggaaaggcctttgcaaaaagattttgtctcttgatatttatgaagcacattcatccgaccacagaagatacatatcaactttgacagaaaatatgaacacattcaaatgatttatacctttgaaacatagatcgttgtggggttcataacccaagtataactttcccacagattcactcaatttccttcctctttctgtgcaatatattgtatattgcaagaagctcacctccactcaccttattcctcaggctttcttctcaactatcttctgtatagatttaaccagtgggaggcgttggcaggagattggagagcaggagaaggggagatttcagggtatttctttccctctttcactgctttgggcaacagctgatacagagtaagtggccaaaaaatactagctattattaggtcttctaataatgatcttctaaaatcactttttcagtggttacccccattgatttgccatgaatgtctcttcagacatctttgcaaagaattgagcctgactttagatactcattcaaaatcaaaatcagtaattttaggattgaggactctggtattatttaagaactcttaactgtaccaagcctcactcccatttctggctttcccctatatatcagttaagtaataactccaatagtgtaaaatttgcaatagtgttatgtaacaaatcaccctaaaacttattgacttaaaattatcaccatttataattgcacacagtctgtggggtcccgtgagctgttgtgttgttctggctcactcatacattttcagtcagctaatgggtgggctaggggctggcttatctagcataagcgcagctaggatgattcacctctgctccatatggtctctcatccttcggcaagcgctcctgggcttattctcatgcaagaaacaggattctaatagagaaggaaacaagacttcttgaagcttaagcttggagctggctcactcatttctaacacatttttttaaccaaagcaaatcacaaggcaggcccatattcagggattagggaaataggttacaactcctgatggtagcaactttaaaagtcacattgcaaaaagatgtgcatacagagaggtcaccagtgcaatctaccacaccttgcaatctattaagtttctcaccccctcacaagtaaggtattcagttaagatgcattcctatgtattcagatttctaatcaactaatcctgattctcacgtaatattgacacagtatcaatattctcaaaagccaatagtctagagggtcacaaagatcctcaaagatactttatgcaaaatcctaggagtatagaaacagtaccttggtttatgtatacattcagtatttattaagtgtttccaatatggtataatgttaaggaatgaggatagagttatgaacagacagacacttgtctttatggatcttacatttggagggggacaaacattaaaatggattatataattacaaatgcagccgttctcattgtcttttcagatttctcagggtgtagactgagctactataataaaaataccccaagtttccatgtttcaaacaatatagatatgtgtatctttcccacataaagtccagcctaggtacgtagtctctgctctaaaaaggaacacaggctagcaaggcagctatactattctcaatataatactgcatttcaaaatctccatgctggtcccacaaatatccatgcactctctttcttatcatcaagagaacacacagtgccttcccaagagagaccagtcaaagtctcattcacttactgcatccagctaaaagtccattgtctgtggatgatgcactgtcttctccatcagatcaagatatggttcctcatggtccagtgacctataaagtgaaagttatgctatctgctcctaccacaaccaattctctctttttaaaatttttttaaatttttgtgggtacatagtaggtgtatgtatttatggggtacttgagatgttttgacacaagcatgcaatgcataataatcacatcatggagaacgggggatccaccccctccagcattaatcttttgtgttacaaacaatccaattatactcttatttatttttaaatgtgcagttacattattttgacgatagtcaccctgttgtgctatcgaatactgggtattattcatttttcctaagtattttttgtacccattaaccatcccgctgccccctccccgactcctccactatccttcccagcctctggcaactacctttctactctctatgtccatgagttccattgttttgatttttagattctgcaaataagtgagaacatgagatgtttttctgtgcttggcttattttgcttaagataatgacctccatttccatccatgttgttgcaaatgacaggatctcaatcttttctatggcagaatagtactccatttgtgtatatgtaccacgttttctttatccattcatttgttgatggacacttaaattttttccaaaccttggctattgtgaatagagctgcaataaacatgggaatgcagatatttcgtcaatatactgatttcctttctttgggtatatacccagcagtgggattgctggatcatagggaagctctatttttacttttttgaggaacctccaaactgttctctatagtggttgtactaatttatattcctaccaacagtgtgcaaggttttccttttctccacattctctccagcccaggcacaaagacagcagtaagtgctggacgaccacctatgcaagacctagactataaatccagtacttctctccctctccacacccccatacccaccactccattctgagttttcaaatgtaagctaagctaaatgattcaataaagctttttgaagtcaaggatgagaaaaatcgttgctttttatgtaatcccaccatcaaagtaataattgcttagttcaaattgtggtgatgcaaacaaggaaagcaagagagcataaaacgggtggatctgacgcagtccagaagtggaggcaatggttgtttttagataattattagagaagatactgtgatttggtttgaaggcaaagctcactgaagttctctagttctagatacacctatcgaaaaattcttacccaaataaatgtctcagtgataagagcagcctttccccaaatgcctaagtgtttttgttttgtttttgttttgttttgttttgttttgttttgtttttgtttttgttttttttcaaaatcttcctctggaatggatgctgaccttgtcattgacttattcttcaccacaactcagtcatattaatcttgaaagagacagagaggccactatctctgctaataatttacataattgtttttctacaatttggtgctaattaaaatgtgaaaggggtagtgatgatataggtaaatgtaataaggtcattctttgttcctgagagcaaagataatgtcaccagaaaggattgtctgtatattcacataagagcaggaaacaggaagagagacacagtaaggtaaaatagcatactagtatatcacgtagtctggtatagccaatgtagaatatttatttcaaaaaacaaataaagataaagttctgcttcactttgagaagctgttttttttaatcctgtatagttagttcgacatgttactactctgcctggttcaaattttgatttcactctgttccagttatatatgctatgcaacaaaccactctaaaagttactggcttaaaataagatagttttacgatttctcataattctgagagttgactatgatattcatctgcttcacctgatatcaaccaagacactgggaaagctggaaagtccaaaatggcctcactcacatgactggcagttggtgctgcctaccagctgagaactcagctaaagctattggccatgagcctcagtttgtttccattgtcttctccatgtgtctcctttggcttccccacagcttggtggttgagttctgtgaagaagccttccaaaagaacaagcaccaatcttcaaagacttatcaagcttctgtttgtatcacacttgctactatcccattggccaaagccaggcatatggccaagttcagaatcaaaatgagaagggactacacaaaggcatgaatccaagaggcgtgattaattgtggggctgccaaataatcgccttccacaaattccttactagctgtgtcatctctctgtggtctcagttttctcacctggaaacaggaacaaaaatggccctacaaaaatggactgagatatattaggttggtgcaaaagaaattgcagtttgggaccgtgaattttaaatcattataactaggctcaagcacatctttattaatcaaagtaggaaccgttacagtcaacacatttttgccaagaagaaataagtgtgtttattcctgtagcataaaaattcatgctttgggattcaatgaactcttggaaagcattttcttcatcctgctagttgtggaagcattttccctgtaaaaagttgtcgagatgcttgaagaagtggtagtcagttggttgagaggtcaggtaaatatggcagatgaggcaaaacttcctagcccgattcattcaacttgtgaagcgttggttgtgcgacgtgcggtcgggcgttgtcacagagaagaattgggccctttctgttgaccactgctggctgcaggcatggcagtttttgatgtatctcatcaatttactgagcatacttctcaaatgtagtggtttcgccgggattcagaaagcggtagtgggtcaggccagcaggagaccagtgaacagtgaccatgacttttggtacaagtttggctttggaaagtgctttggagcttcttctcagtccagccactgaactgggcatcgccagttgtcgtttaaaatccactttttgttgcacgttacaatccgatcaagaaatggtttgttgttgttggcgtagaataagagaagatggcacttcaaaatgacgatacttttattttcgctctgcttatgaggcacccacttatcgagttttttcgcctttccaatttgcttcaaatgctgaacaactgtgaaatggttgacattgagttcctcggcaacttctcgtgtagttgtaagaggatcagcttcgatgattggtctcaatcggtcattgtcaacttctgatggccagccactacgcccctcatcttcaagactcttatctcctttgaaaaacttcttgaaccaccactgcactgtgcgtttgttagcagtaacttggccaaatgtgtttttgacattgcgagttgcctctgcttctttacaatccattttgaactcgaataagaaaaacgctcgaatttgctttttgtctaacatcatttccatagtctaaaataaacataaaataaacagcaagtaataagtcattagcaaaaaaaaaaaaagtgagaaatgctcattaaaatgatgtataacataatcacatttatttaagaatgtatttcaatatcaaatggcaagttccatgaatgtgaaaacaacacttacttttgtagtcacctaatgacacatttaagaagctgaaacctgagctcagcacatggtaagacatcagtaagtattagttatcataatttttttagtaattttcctacagagctataaataaaatgaaatactttccaaacagtgataaaactataaagcagcaatacattataagcttctatcctaatctgccttcccctcagggccttaaaatgtgtcatttctgtaaatgttacctctgacatgaaagcaccaacacactgttcagcaattacaagttgattgtgacaagagcctcactctccctatttctttttctcttcctgtcttgctttcccttttccccatcctttcactcactttgataaggcaaactgccatgtagtcacaaaatcctagacaaacaagtctgtacctatgtgggcgatgctgtggatttagtaagggaaacagttccttgataaatttctcctttagccctgggtttccaacccctgtgtcattcagctatagaaatcttctgatattttctcccactggtcattttcactcaggctgccatcaaaatgagactacccaatgttctttccatttgttctgttttcttcctcgcctctgattccctgcctggtccacttagaaagtctaccttttttccttctctcttaataccaccaatctctaaatctgacttctcctttctaatcccatagagcctgccttgtcatctccaaacaagatccatcttggcctcctgttatcctcagcccacagcagtatttcacttacaacgttcgttagtttctacctcagatgtgtcaggcatttagtttgtaccaatattttatttctttttatatctacaccaagcctgcactagacggtccaaggagaaatttaactgattcctgttttgaagtcctccccactccttgggagagttaaagattcctcagtgtgttaggtaatgatagttaatatttattaataacttactgtgtatcgactgtattctaagtgctttgcactgttagaaggagaataacctaagactgtgccaaacagcagtctagaacaaagctgaattccttgcttgcctggcaagggagaatgtggtacatactaaaggattaatacatgttcactattaaattgattgattgtggtggtggtgacagtggtgatgacttttcaagtgtgggtaaagtaattttttccaacaaatccacatccacatatttaagaaaagagagacatttcattctatctttttgtgtgcctttgagaggacacccctggcacccaactcccaggcaaatgccaccatctgtgtgattttccttcatttgccaacgaaggcacagcaggtactactaggttaacctttgctttcgcaagtcttctctcaaaatagtaaacacttcagctgttggaaagctctaatctcaaactgcaaatttaaaaatctctctctggagttcaaaaaatagaaagaaaaaataaaaatctctctcttctggaacataatgtttgaactgttacatattattcacactatttcacattatgggattatgaaatatggttttaggtgttagaaaaacgaaagaaaactattatttgttaacactaaccgagagatttttatgatattcaagtaaaatgatagaatgaattattttaaaaatgcatgaatcttcaccttctgtgaagtgtcatggaggattagttctaactaatatgcctgtaagtaactgacttaatgcgtctattggttctcttaatgctgtaagtgacagaaaactggtctcaaactgatttaaacaataaatatgatcaaggttccggttttttgtttcttgttttttttttttttttttcacatttctctgggttctatttttctgtgttgacctagcagcttcacctgacttccctcttggtgacaaaaatggcctgaagccgtttcagaacccacatctgcaaacttacttttgatgaaaatcatctctttagggaccttctttcccaaagcatccaggaaagactgctctgaaactgactggcctgaattaggtcacatgctcattcctgtactaaatcacacctcacttctacagctaaaagtcattaaatctcaaccaaactctacagctgcaccacaacaaaggtagagaagtaggtgcaaagttcctcaaaggaacgtaagggtgaaagatgattgactgataaacagacaggtagacagaatagatagatgaattaggaaaagataaccaaccaatatctgtcacattgctttgacttgattttttagtcaattaatgaaactgaatggtaattttgacattacaacaatactttccaaatgtaggcaggttgtggagatcatttaaggaaaaaatgtatgaggtgttgtagcagatactgtcggtgccccaccgatatccctttagcacttaccatttttatacgtgcttcttaatttccaacttcctgtacttgcatctctttgcttggggctatctctgctcattcttgggagagagcagaaatgtagcagttatgcccctgtagagcagcagttgatagatcaataccctgtcccccttgcccttcagatctaataactccaagcttaattccctacatctttcatataagtatatatataagtatatatatatacttgaagttctagggtacatgtgcacaacgtgcaggtttgttacataggtatgcgtgggccatgctggtgtgctgcacccattaactcgtcatttacattagctatttctcctaatgctatccctccccagccccccaccccacgacaggccccagtgtgtgatgttgcctgcgctgtgtccaagtgttttcattgttcaattcccacctatgagtgaggacatgcggtgtttggttttctgtccttgtgatagtttgctcagaatgttggtttccagcttcatccatgtcccttcaaaggacataaacaactcatccttttttatggttgcgtagtattccatggtgtgtatgtgccacattttcttaatccagtctatcactgatggacatttgggttggttccaagtctttgctattgtgaatagtgccgcaataaacatacgtgtgcatgtgtctttatagcagcatgatttataatcctttgggtatatacccagtaatgggatggccgggtcaaatggtatttctagttctagatccttgaggaatcgccacactgtcttccacaatggttgaactagtttacagtcccaccaacggtgtgaaagtgttcctgtttctccacatcctctccagcatctgttgtttcctgactttttaatgatcaccattctaactggagtgagatggtatctcattgtggttttgatttgcatttctctgatgaccagtgatgatgagcattttttcatgtgtctgttagctgcataaatgtcttcttttgagaagtgtctgttcctatccttggccgacttttcgatgaggttggtttttttcttgtaaatttgtttaagttctttgtagattctcgatattagccctttgtcagatgggtagattgcaaaaattttctcccattatgtaggttgcttgttcactctgatggtactttcttttgctgtgcagaagctctttcgtttaattagatcccatttgtcaattttggcttctgttgccattgcttttggtgttttcatcatgaagtccttgcccatgcctttgtcctgaatggtattgcctaggttttcttctagggttttatggttttaggtctaacatgtaagtctttaatccatcttgaattaattaatttttgtataaggtgtaaggaagggatccagtttcagctttctacatatggctagccagttttcccagcaccatttattaaatagggaatcctttccccatttcttgttttttgtcaggtttgtcaaagatcagatagttgtagatgtgtggtattatttctgaggcttccgttctgttccattggtctatatctctgttttggtaccagtaccatgctgttttggttacagtagccttagtttcctacatcttcttttagggataacagggagtattaagattcagttgttcacattgatgacttgcatgataatataccctttattggctatcttccctatttcacttcttctcaccctgttgatgtgtcctggaatcacatcccaaaactacttgagctcaaatttttatttctgggtttgctactgggagacccaaatcaagacagttggcttcagtactcaggtacttacaaggagatcatggatatcaattgaatcagaattccatgtcatagcttttcaaatttatatcacaataagttgaaaagatgttgattcttccttccacagtattttctgtttctgtgtgtcttacattctggtgtctcaaaacatggctgcaaccagggaaggaattgaaatttggagtaaatgtcctattttagtaggtctacatttaagacatggacctgaaattgagatcataaacaaaagtagatgtgagcataaagtagaaggtgaggttggagggggaaattgtttggatttactgtaaccaatggagctgcttagtctagtcaaggaatttcaatcatttctgtggagactagatgacttatgttatacaaggatatctctggaaaattcactgtacagttttactaaatctggctgataatatgttcactcaatgttatgatgtcaataatagaatggatattgcctttaaagacaattttaaagtaaatatctcacatattcctactcatttatcaagggctgtgtcattcatggcaatataagataattcttttcactttcaaaatcttccagatgcagaaactttccaatatttgctgtagatgaaagtgtacaatttcacaattcaatgggacaaaaagaattaggaaaaatatgtttcagagagtttatttggtatcatctacaagacctggtatgagacctggttggtgttgtatggaatgaaatatatcagtctgttctcacactgctaataaagacatacctgagactgggtaatttataaaggaaagtgatttaattgactcacagttcagcatggctggggaggcctcaggaaacttacaatcatggcagatggggaagcaaacaccttcttcttcacatggcagcaggaaggaggagaatgagcaaaagagggaaaagccccttataaaaccatcagacctcgtgagaactcactgtcacaagaacagcatgagggtaaccgcccgccgtgattcaattatctccacctgatccctcccaggacgtgtgggggttatgggaacaacagcttaagatgagcttttggtacagacacagccaaaccatatcatagagtttcgaatctgaaaaacaaaagaagctaatttagtttcagaaagctgagatttcatgaaccatttaaaaattcactttataatttttcatgcattttgaagcctttatcctttaaatggaaatggaatagaactattattcgtcatttctaaactgtgcattcatcaacaattttcagaagttaattccaacatgtcttcatcaactctatattacatgttagtacactacatctctattttcatgctataattttttactttttcctcacactttcatctcaccctctcaagatgtgttaatcccctttgctcttttccccatctcgtctctgttgcctttctccccccttcctttttttttaatttctgttctcttttacctgaaatctccctcttcatcttttgctaccaattatgttcttaattggttgaagtgagcaaggtaggaaattctccattttgattccattctctcacatggtttatctttaatatgttttaataaacagtttaacataaatcttacttccaatttaacatgtaaaatttagaaaattggtgaaaaatatgcctgctttttcacccccaaagaaccaagtttaaaaagttttgtgactttgaggcatccttttccctaaaagcaagcttaacagattcttagcattcgtctctgtgtgaaattgtggaaactttaaaaaaactatttgaagtaccaacaactcaaagataaattgtctgttttaaatgcaaggtgctaaaataaaactagaagattgacaatattattcatctttatcactgttctacttaaaatttgaaaattaatgttagaaatgtgagagggtgcatgaaaccttaatggttttatcatttcatctgagtatatatttgatttcttctttctgacattgaaactttaaaattcgccactatttttcagtaactcgttaaaatatggtccgttcttatatttgcaatactcctatactgaaaaccctacaacttcaccattatttaatttttatgttactatatttgtttcttaaaaagattataatattatgtattagttgtctattgctgcataacaattactacaaagataggggcttaaaactgtatctttagagtatcaggatacatatgggtcagaagtctaggcatagattatccatattctttgcttcggggtctctcacaaaggctgcacactaggtgttggccagggctagggtctcatttgaaagcttgccttggaaggacctgcttccaaactcacctgttgttggtaagtttcagttccatgtgggttattggactgtagtcttccttttcttgttggctgatggccacgtttagttccttcggtctctaacatggcaatttgcctcatcaaaatcagtgagagaaagtgggggaggggggaaagagacagagaaagagtgaaattgctagcaagacaaaagtcccaatcttatgtagcctaattggagaagtgatatccttttgtctttgacatattctgcttgtcagaagcaagtcaaaagtcttgaccactctcaaggggaggaaattattaaaggactcaaatactaggagacagagatcactgagtgccattttagagtcttcccaccacggattatttcccttcacctgctggcatttgaaaatgcagctaatactctgggattctccaaacctaatttttttgtataattagagaagtatttgtcataatctgttaagtgtagtaatatattaagaaattgaatttattccttcatatttcaaaaagtacatggggttgggggacagctatgttgtcataaactttaatacatacatgattggaatggattatgaaatatttttctctaagagatagtataaggctgcaaccactgaggctcccaaatacagatgattcatatgtatttagttttaatgcaaagcttctcatgctgatttaaactctcatattttcatatatggtgttttattttttatataatgaatgtctataaaattcctattattttttcaaaagtattgtggcaaatatttcctagtaaaatctaaagatatctttgacgtaatttttatgctctcatttatgttaagaactcaatattgaagtaatgttctttcttatttcctagtaactaaaatccttactatattcatgaagagctgtgcctctattaaaaagcttttattgcaaacagaaatgtcaaaatacagcaaaggtagagctatgtatgattcttcatctgtaatgtaattttaagtatacattttattgcataagcagagatttatacccacatttgctttcagtattcacagaagaattttcatatgtatttcttaaaataacaaaatggctgctttggtgtggggatagtatggtacagcatttattgtgaaaatgattcttatcttccatctttttcaaatggtgagttcagtatgtttaacattgctggttttataatattgcgaatatttttgagaggaagaaacaataagagactgataagaataattcatatttgctcaaagtttaatcagttttttatttgaacaaaaacttggacgaaatgtccaactttcctttgagatcagtgctctccaatgtggtaacaacagcctaccatatgagcatttgaaatatggctagtccccactgaaatgtgctgtaagtataaaacactcaccaaattacaaaacctaagtatgaaaaaaataaaatatctcattggtactttttatattgagtacaggttgaagtgacaacaatttggctatttaagttaaagaaaatataacattaaaattaatttgacctgttttttacttttgtaatgtgtagaaaattttaaattacatgtatcgctctcattataattttattggatgtcattgttctagataaacaatggcaatgttgagaggtgtcataatagggacaattgtctctgtgaagaagaaattatatgaaccctacaacatgtattagccgcagagttgcttagaattgacttactctgtcttgttgaaaataggttttcccttaaaatctctgcctgatgtagccaaccacgattcaatgagcaaacaaaaatcttaaaggggaaaaaatcattttttgagtctattttacacacccagtatcaaaaagaaaaatataaatccacaactaggattatacgggatgtaattcttggatttcttttggtcttataatgctttatacctaggagatgttcaacaaattattattgaatgattgtagtttaaccgtcagttacattttgcagcaatacatttattagtagcaaaatctgagtgtttactaattttcatcacctaatcagcaaattagtactgctcttatatcgctttgcctacgctctactcactggttcaatcagctaattttttcagaattttatggtttataaaccactatatgttgcacagtatttcctatacattagctcatttgagtcacagaagttataggaggtggatcttgtctttctttgttcagaaagagaaatccaggttcagcgaggttaactggccttgtttaagatcagcacgttgctaggtgacagaaggtgttcacttctcactgaactttgcatatcaaaagagatttaaagaattcactttggagagcgggagttatggggtgaatattttatcatgttgtccgtcttaataatcaccaatttgatactaaggctgctagtcatctctaacgaagagaagttactttgaagttggttgattgattgttgttgattgacagaagtattagttttcagaatgaactaattcattaaagaaataaaacattgggtttgttcattccataaataattgaacatttattatgtgtatgataccagcctaagcagatacctaaaaggaatggagattactatagttaataacaatgcattgtattcttgaaaattgccaagagattacattttaaacattctcaccataaaaaaatgataagaatgtggggtaatgcatatgttaattatctcaatttagccattccacagtgtatgcatatttcaaaacatgttgtacacaataaatacatacaatgttatgtgttaatttaaaaataaatacattagaaacggtaaaagtcactaggatcatggaaataaaaatgtttacatttatgtaaatattagtaatataatagagggcatatccaaaatatagtgtcatattaataagatgttgtatgattattatagactacaaaataataaaggaatagacagaatgtttctaaataaagaatagaaattacagtgaagcggaagagagagtaaccctaaacccttcataatcctccctttgcctcgtagtatagcttggaaagtaattatgtggaaagttgagattgcaacaaaggacggtagtacaggagttgcccaaggacagacaattattttctcaaataaactatagcagaagcaaaatggccttggaccacaaaagaaggccctcatgtagacattgttctattctgaagtagaatttgcagtactcaagagaagaggaaagattattataggtggagagactgtaaacaaaatattatggtaggattcctcctgaatagagcaaggtgattgtgtttgacattgaaaaggtatgtttgggcaagagtttgaaaacctttagccaccatgctaagagatcttaaatctttatctctgagtaagggcggtggttgtggttaatgatccttgagcacaactctgtcccattaaagacagtagattcaactgcttctagcattagtccatatcagggagtaaagtgatccgatacattattttcccccagtaaatggttcataaaggaaggccttggctctgccttgtatgtctacatgggagaatataccagaatgtctagaggagcatgggtagcgtaacctttccccatatgcacatacaacaaatactgataatccactcacaggggagggactcatttttaagaattaagttttattttagaagactcagtctgatggcaatgcaggggttgaattacagcaggtagagactggaggtctacaaactggtttgagatatatattttttccggtggcccagataataaggacttgaacagacttcttgctctgggaatgtaaaaggccaggctggatgtaagaggttaggaagttccaaactgtcccacattttcctttcttctgagccctccaaactgtaccagactctgcatgttacgcacttccaaagtcgcttccacattttcgggtgtcttttcagcagtgccccactctactggtaccaaattactgtattagtccattttcacactgcggataaagacatacccgagactgggcaatttacaaaagaaagaggtttaatggacttacggttccacttggctggggagacctcacaactatggcaccaggcaaggaggaacgagtcacatcttacgtggatgggcagcagtcaaagagagagcttttggagggaaactccgcttttcaaaaccatcagatctcatgagacttattcacaatcactagaacagcacaggaaagacctgcccccatgattaaattacctcccactgggtccctcccataacacatgggaattcaacatgagatttgggtggagacacagccaaaccgtatcagtgatgcaaaataaaagaagactgtggagtaaattacacatggagaaaaggaagaggaactaggaagtatagatactgtgagaattaactctctgttctacaaaagaagaaatgggcttaaagtggttccccccaaaactaaaatccaaaggcacataagtcataatgcacactgttacaccgagtccttccagctcttaacttacttgttttactgcactacacttgacttgagttttagacttagtaaatctgaggtaaatgcagattgagaatgagaacaaaatgttaaaaagagaagcagtctcattttcttactactaataggcattgcagtttgtgtgggctctagcagggatgtttgtaccactgggatctaagcatctatttctatattataaatagaaaaattaggttgagctatcgcgactccattacaaacttatggaattagattctctggtatggagcttggatatacatattaaaacaaaataaaacaaaaactcctacccaattgattctgctgtgtgctctagttaagactgttatggttaagaaaataaataatcgctgtatggaatgtatatcgtcctattttaaattaataaaaaaaattttgcaggccttcccaccttccaactcctagagacaacaaatccagatttgaaaatcagtcatattaaatagttgtatcgatatttaccctttgtttctacgttattattttcttcaattttcacacgtatttgttcatcagttggttatgatggacttcactttttttcagtcttacgaatgagatttctccctccaaaaatcaataggcacctgctgattttatttattccaacatgaagttgcagaaaatgaatatggccaaaaatggttaaaaaaaaaaaagcctgttcttcaaaagactagatcgtcagttgaagcagaaaattatattcagtgcactggatttatgcattgttttagccttctccaaccaatttagaaatgcattttcttataaaattgagattattacaaatcctgtgctaagcagctgaaataatgtgcctatgccaaggtcatatcttaaaagtttggaggagcacactgcaattgaatataagtttataaatgtattccacatacttttctgatatattttaataatttaatttttacattttacctatattgtcttcattttcactttacctttggtggtgtttcatacatattcattgtttggaagaaattaagcagacagtattctaaagtcaatactgagtctgctaatgaaaatggttaagttaattaactaaatggcaaccttcactgaacttattcaaagctatttcccctcatgatgtgttttcctgaagaaatgatgcataaaaactaaacccctgttattcgctattcttctgtatcagcctctaaattgtcactttacatgttacaacctgttgcatgatgattaattatgacaatttaatggcatgtaaagggtaaaaccctaaaggattactcaaaccatcattccttaagaaaagaaattgtaatgcctaggttatcttctagggtttttatggttttaggtctaacgtttaagtctttaatccatcttgaattgatttttgtataaggtgtaaggaagggatccagtttcagctttctacgtatggctagccaattttcccagcaccgtttattaaatagggaatcctttccccattgcttgtttttctcaggtttgtcaaagatcagatagttgtagatatgcggcgttacttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaaggcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacatcccttgtaagttggattcctaggcattttattctcttgaggcattaccattcaggacataggcatgggcaaggacttcatgtctaaaacaccaaaaccaatggcaacaaaagccaaaattgacaaatgggatctaattaaactaaggagcttctgcacagcaaaagaaactaccatcagagtgaacaggcaacctacaaaatgggagaaaattttcgcaacctactcatctgataaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggactataaatcatgctgctataaagacacatgcacacgtatgtttattgcggcgctattcacaatagcaaagacttggaaccaacccaaatgtccaacaatgatagactggattaagaaaatgtggcacatatacaccatgcaatactatgcagccataaaaaaggatgagttcatgtcctttgtaggcacatgggtgaaattggaaatcatcgttctcagtaaactgtcgcaagaacaaaaaaccaaacaccgcatgttctcactcataggtgggaattgaacaatgagaacacatggacacaggaaggggaacatcacactctggggactgttgtggggtgggggaaggggggagggatagcattgggagatatacccaatgctagatgacaagttagtgggtgcagcgcgccagcatggcacatgtatacatatgtaactaacctgcacaatgtgcacatgtaccctaaaacttaaagtacaataataaaagaaaaaaaaaagaaaaaagcaaagaaattgtaaaatgttgttctatcagaaactcggctaattatttttaaattttagatcaaaaactcaactagttttaatgtactacttataagtcagataaaatcattttttatttttgttttctttttgtttttacatctgttagaaacgatggggtcttcaaagtaaaagaagagatttgcaatgcctataccaaattagttattttaggatactgaatgaaatggttttctatactcaataaaggtaaaagaataagcagaggtagatctggttttctgaaacttgaagcacattctaatttggcagttttctttaagtcaaagaatataacaggacaaatataaaattaggtatgaacatgattatagaaagaaaggaaatcataacaaattatacgtttttaaaaagatgacagataaccacatacatcacaaaaattgaaaaaaataagcagaatgttttcttaataatgaaccatctctgcaatactagaatatacagtgtctgaaataattttttctatctttctggatgcatcctctttcagcacctcttcatgtgagagcatcagaaaataatttactctttcccccagcattgttgattaaaatttgacttctatcattgatagtttagaaaagtttattttacattttcaacttattattggtgatgtcacataaattattacaatttattgtccaatttaggaagaccctgccaagtttctttcacatatgaactgtaaaatttaaaagatcattcaagttatcttgtacaataactaatacatatttttcttttagtcatactaaaccctgatgctaaggatcacccaaactttttcagggaaagaagtagcttgcaaataaatcaaggaccatttatccttactttttggaagaaatggaaaaggataaagtgttagtttaaatacactcaagaacagaatgtaagacaagaaattggaagcagagaagttcatcctcaaatgtaagagtgaaagaatagggttaatgaaacaggaaaggggaaatccaagaaaaattatgccgcgctttagagaatctcctaagcacagagatattggcaatgtgcagatgaaatagctgtcacaggtcagccatgtcagaggtgattccagccactaagtatctactgcagattagatatttggaaagcagaatgagctctgttcatgccattactggggcttgacttcttaatggtttcaagtccccctttgactctaatccttctaaagtcaactttgtataaactcttttcaaaagtgtttatccctgtagaataagttcaaaactccatgtcatggcacacaaaactcttcaaatcatattcagctggtattgttttcttccacattccagtcataactaggatcccaagaattagcaaataaaaatatgaaacatccagaattctaagcataactatgtcccaaatactacaacaaaaaatactgaaaagtatcgattgcttatacaaaatgtaaatggtatcctgtattttataaggcaaccctagtcataagatctctttcttcttcctcacacactgtcaagcttgagccaacagagtaccttttaatgggctgcgcagaatagctttcgatagtttacccattaattaacagaaaattcaaatgagatatcctctgtgaaatcatccttctctcctgcctcctgtctctccattctttctccaggagacagaggccctccagactccatgactttgtagtgtattgtgtctgtctttattagagtattcatcacttggtaattgaattctgtgtttaaatacattttttttcttccagaataagtgttcatagaagggagggatgatttacctagcatactgcctggcatataaaaggccctaaataatttttcttttaaccagtaaccaactaaccaattcaacagttttttaaatgagtgaaaccactttttaaatttttttttaaattcatgcttcacctgtaaaaatatatagatgaattgcaatctggaactctgagtaatttatataaaagtgatgaaaaagaccatggcttcagatttgttgttttaattccagcttcagttcatacaaacattacaaagtcgcagtatctactgtgtaaaaagtttcatcccaatgaagaaattaaaatgtctgtctaatagagatgctctaatggacagcgatgtgtagacttcagaagaatctcctcacacagccttggaggcataagttgggaacagagcaagttctgtgtttgcctttcaaaggaatgttcctttccctttcattgacaaatattataaagatgccccaaaacttctgtgagtttcccccgggacgtaaggtcctctgcattttcctaacttgtttctcaaagcggtggttcccaaggcctgagaatagctgtgtctcagctctctcctggaaaccagagcctaaaatgttgccacatcatcgggaatgtagctgcatacttagccagagccaagagatgagccccactcgcaaagcccatgggctggacaaaattgttagccatttggtgtaggtcattgcactaggtccattacacaggttatctggcaggagtcccggctttggaggaaagacgtttaaatcctgtaaataaatggctggaacaccatggcagttgattgtgttaagccctcatccaaaattgctttgttaggttctattctattgctcattatcttgctgtgaagaaaattaagcttacatctgcttagggtgacagggtatcctgttgtcacaggattttccacattttaggcctatgtcacaagctcccaataaaccctcagagaagatcttttgtgttcacaggcatccaggtgtcaggcagacacagtctttgtcttcttgaagctcagtgacacgttcagggctgtgtatactcctccattccctgccagagacaaaatgtttgtggaacagtcaagctagaagggacctcagaattaatctgatcaaatgtctgcatttttcagttccaaggatactcagggaaggccctcggattctataagtagcggtagaggtggtattagaagtcaggttgcctgacttccaaacctctgttagttactgtcccttcccctgcatgcagcactagtgtaatccctcaactctcacttccctttttcgccacatgcctctctctctttccttcccttgattaccctgcctatccctcctacaagggaaactaccaccaggcatcctcatctgagacccgggaatggaggccaggtcttttccctccctccctccctttcccctttttttgtgtgacagtaacattattcaagtacagctcttccttttttcagtaccttccccctcagaccagaagttaatgaaaaatagggttgcgtgatatgcagcctgggggccaaaaatgtaggacaagcagtgtgcttcagacaaaactgtagggttctggtttcatgcacaaccttggaggacggtggctagaggccctagtatgagagatcaattaaacatggaggccagaaattaaccacatgggattaacatacgtaaggttgcttcttttcaatgagtctaggaaacacactggggacaccttgttcaagacaagctactatttgatgctccttcatacgcttgcttaaaatatttgttcagcatttatttagtgggggcaagaaaaattgatgttatgttaataagaaaacctctttacctcttaccttttattaaaataatcaacttagaagatatactaaaactcacatgacttttgacatctatggatgatctttcatttaatatttttctgctattcctactatagaataaaagctgctattgcattattacagagcgtaatgtgagccacatatgttattttaatcttaatggccacattaaaatagtaaaaataaacaggtgaaatttatttggattatatgttttatttaacccagtgtatctaaaattgtatcattttgacgttgcaatcagtgcaaaaatacagtcatgctatgtgtaatgaggttttggtccatgataaactatatatacactggtgatctaataggattataatacagtaggtttaccatacctttttctatgtttaggtatgtttagatgcacgagtacttgccactatgttagaatttcctgtagtattcagtacagtcacgtgctgcacaaatttgcagcccaggagcattaggctatatcatgtagcctaggtgtgtagtaggctatatgtaccacctaggtttgtgtaggtacacactatgatgtttgcataaggataaaatcacctaatgacacatctctcagaatgtattcctgtcattaagtgatgcatggatgaattaaaatattttggattctttttttttttcagtactatgccttcggaatccaatatgtattttacagcatatgtctattccaaataggcatattctgggctgggtgctcaatagctacatgtggttagtggctaccatattaaccggtgaagttctatgcccatcaaggctacacgtaatttacagggtataatagtattttaaaaattaatttttttctggcttttatgttgacatatcgtttccattttttaaatttttgttttattttctttcactgctttggaaacgcacaacttcttggaatgcaaattaaaagatatcaaataatgatgtagataatttgttattgctaaatgtctaccacttgaaatattcaagtttcaaatttcagctaactgcgattgcaagcttcagctagctggtcccagatggatggcccagctaaatcagacatttgtacatactggctacaaagtgtcccaaaaacagaccaggagggtcgtggatttaaaaaaatttccaccaaaggatgctgtcttgtccattttccaatttgggtaaattaatggatactgcatttaaaagtttttttatttctcgtacattgaagccctgtactgcactcaccaactcacccgttaaagcggctctgaaatacaggcaggaccaagacttagatggactggaggttgggccacaactccttgaacacctagagcagaggtcagcaaactttctataacggtccagatggtaaatgttttaggctttgcaggccaataggtctctgccacgactacttaacaccgctattgtggatcaaaagcagccctaatacgtaactacacataaacgaatgggcatggctgtgtcccgtgacaatttacttggggacacaaatttgaatttcatataatattcatgtctcacccatttattaattattttcagtttcttcaaatgttaaaacaattgttagttctcaaactgtacaaagacatatggtggctgaatgtgacccataagccatagtttgctgccctctgcccaagtctcctgttgaaatggggttatggcaacaatcctcgcagaatataaaactattttggcacctgacttttgccctgatttttttattgtttccagagaaatcaagtatttttctttttcaaatttatatccatattctctttttttctttgctctcttctcttctggccagcaggaagagaccaacccatctttgaattgtattcactttcctcataccgtcacacagctagtaaagctacaacttcacatatgccaatgccaactcttcccgatgttgtgttcaaaacctttctaagcatcaccattcccaggagtagcaattctatatgatattattattttacttgttggtaaggttaaaagttccagggatactgattttcttctttgttagccatgtttcattgagtggataagcaatatgcatttgcttcatagtataaataacaataatgcatcaaattgcaacaatatgaatattacacatagaaaagataaatgtgagttatgtaggtcatgccatttgatagaaaattttttttatatttatatgtttaaacatgacaataaaatgattccattcagatgaaggcaaaggaataggatttcttttcagtgtggtggttttctatttttgttttgttttgttttgttttttagagaatgagttttggagaaaaacaagctttctagacagaaaatattgaaattaaaaccagcaattcatggtcatattattgaaactatcaaattggtatatatatttgaacactactgattattttctaaaatgttacgctttcaaaaaatcatgaagattggcaagttttttagatgcataagcaaatagtgtagtacggcttgtaacactgttcaagataacttttttataatgagtatggtctttctctgccctgtctaatacaatgtgggttttgagcattggaaatgtggtaagtgcaactaaggaactgatatttaaattgtatttaagtttaatacatttaaatttaaagttacattttgataaattgctttgtttttcttttttctttctttctttcttcttctttttttttttgttttgttttttttgaaacaacaatctcactatgttgcctcccaggctggtatccaactcctgggctcaagcagtcctccttcctcggcctcccaaagtgctaggattataggcaggcaccaccatccccagctaaattgtttcttaaatgaaacttctgaatttgaggatacgtgattatgtggtgtagttttccctttctttccccccctgaaatccatattctgaagtacagtgatttatataaaagtaaaaagaaggagactgttttttttttttaaattctattaagaaaccaaattttaacagacacctcagggcctaaataaatatcaagttattgttatttgttatggttcttgttgcttgggtaaaactgtacagatcatgacttagttttccttgaatttttatcaaacaaatgaacaaaatgagcaaacaaaaatattaaaaatgatatttcctacgaatccaagggacatttttctgtatcagccaggctgatgctaaggtccttcaagcaaataagatcaaagatttctgattggagagtgtgggaataaagtagcccttgtttagtgctactttgtagagcctttgtttagagtacggctgggagggagggagagagggagaaaaatacggggttaatttgtaacaacacattctgtggtgtgcgtgtgtgtgtgtgtgtgtgtgtgtgtgtgtgtgtgagagagagagagagagagagagagagacagagagagagattaaattacatttaacttctttaaattttattgtcctcagggtttaaacagtatgtgaccaaaatcacattatttagtgaagagtttgtgggtaggtggatagttagatgggtataaatccctataaaatccattttagaactattgaggtttgagcaaatcaatgtcacctattcacttcatttgtctaatgcctccaggagccattaaagggcttgttacctaactttagggtaggtttagatcaaggtgaacagtcagaaaatattatccatgtactcacgtatattattaagtattctttgaccatggagttagatgcttatactgcaaacaaataaattaatgaataacagtgctgctcatgaacaccaaagtttactgaaaagtcaatatggttttagtgtggtaataagggcagagttctccaaggactgccaacctatttattgtacatcaaattttactgactttgaaatcttgctagaaatgttcatttacctcgtaatgtattatatgtttgaggtcttgagaaaaataacaaaatccatgtgtggtaatgaagtggttatgcaataaaactaacatacactgtgatttgacacaggggacttcactgttatcagatacttaaaactggaaacaatgtaggaaatatagatgtataagcatcgtaagtaaaatccacatgctttaaaaaggaaatccacttacttttaaagtaatattccgagagctatgccactgggggctgaatgtcataaaaatgatttgtaattagtcacttttacattgtatatggatttatagttttaaaatatctggtggcatataaccacaatgtatttttcagtcatatattcatcattattttattaaatttccagagggaaagaaaataaatgacctcctagtgagggatattttaccacgagaccagttgtaaaaataatcgagttttgtgcctgggaagatatctttgctaagtctagttctccagtgacattaatttattgttgttaagaaatgtgtgaggcaaaatgaactctccaaatatttcatactacgtgcattttatccaaaagaagataatggtttacatgaattatttaattggtattactaatttgggggaggtgatttttggttgggggcaacagaatatttgcctaaaatgcattcagagtgcgctgttatttagctattttcaaggtagagggatattggcattggagacttacacgtagccatacaatggccaacttcagtcaactacagaagcaatacagggcagcggctggaacaaaatagctactaggtaaatattgattgaattaattacacggatattaccactagtcctgcaattaattaatacctagccctgtctccagccccagaatccatgacatcaagctaactaacagaaaacatatcaagaattttattccttagtcctcttgactgaccctcaagagggtctaccctcttctactctgtattcctcacatcaaatttcactagtccagccgccaagtaacacctgttctgactgtgctagtgaacttggatattcacacatagcctaaaatgggaaacagagttggaaatgtcatgtataaggacataagcgttttcaaagtgtacaagaacataagcgtttttaggagatttaccttctcttttctgttttattagcgaatgattgattgttttgtatgattgttcatttaacaaatgctatatcatgtaagaaaagttactaacggtatataaagatgtaaaattcaattgtggctgtgtgtatgtgtgagtattctagcttttggggagagacaagagaagaaagaagacataagttggaagagaacagtaaaataaagaaaaaagtaataactgacggtgtctaatgaagtagcccaggtaattaatgctagagtttattagatagaatcattatttccttccagagggattaagcaatcttctctgaggaggtggaacttttattacccaaaacatgaaggattgggaagagttttatatgtgtcgataaggaaaagagatattttattgagggaaaagaagacattttaatggcagagtacacaatgtcagaggaacagaccaaaagaagtgctttgttattaggaagatttgaagaatggaagatagcgtcagattgttaagaaccattttttagataaaggcaggctaaagaagttggaggctattggaaatcagtcacacaattttaagcaagagaatcaatgagtggcagttttgaaaactgaatttgatagtggcaaggaaaatagggctctatcatcccacttactttcaaagttatgaagaaattgtagtaagctccagtcagtacctaaaggaatttattttgtgaaattgtgtaaacaaaaagcaaaccttcttttgcactcatatagtatattttctcaaagtcatatagctaaagggaatgagaggtaaaatagtacagtggttaacaggataggcttcaaagcctaacttcttgggttcaaatcctagcttggttaccatttcacagctatctgaccttgtacaagtcacatgcgtacactgggaacaataatactacctgtattatagagttgttattagatgttgttgatagatatgttgggcacattttaggcactacatacataaacctctttctatagaagtatacatgtgtacctatatttaaaataatgattttcttttttaaaagaagcacatattcattgcagaaaatttttttgaaattttaaaagtaaaatctctggtctaagtgcactaaaatgttttagactttagatatgaactacaaaaacctacctcatcgacacccaaccccactcccagagatatttcattttatttgcttgctatcagtaatgagaagacccaattcaccacacaatttctgttgtatgagactattgtattgcagtgcaagatagtgttttaaatctttgttaaatcaataggtgcaatattacacctccctgtttgaattttcctagtgaagtcaaacaattttaataggcctatacataggtcagttatagttctttcctaaatggtctattcctcattatcctttttaattgagtatttgtctttttttctactgatttgtgagaatgtttttatcttaagagtgtcaaaaagatgaattgtttttgcctttttctttggcttgtttgattttttatgtaaagaaattttatactgctatgaatgtaagtcattactttatggcttttaaattaaaattataagaatagcctcccatattttcattacttttatagttcaatttttttacatgtaacatttcattcatctggtatttagttaggaattgtgtgagataggattttaaaattaagttaaaattcaatcaagtctttattttttaagtacagaagtttccgaattcagcatttacattaaattttttgaaaataatgctaaaatatcatgtaaattattacttattggaattgaaaattccctattattatttttaatctttataacaacttatgttatctatgcttctattataaaataaatgacaagccaaccaaaatagagaagatgcttatcacaattatatcatgataatttaaacatgattttggattaatcataatccaaaaatgcatttgataagcattctaactgttcttctagtccccataaaattaacaaatggcaaacagtaatgttttaattttcaaaatattcatattaatattcattttcaaaatatgtttacttgcatgcatttcatttatattatttcttattgaagttgacttctcaatgtatattgctttaatgatactaagtattaagggtatagattgtactcacacaaataactattgaaaagcataagtttaaatagatccatttatcaaatgatgtctttttttttcttttttttttttttttttttttttttgtgagacggagtctcgctctgtcgcccaggcaggagtgcagtggcgcgatctcggctcactgcaaactccacctcctaagttcacaccattctcctgcctcagcctccagagtagctgggactacaggtgcccaccaccatgcccggctaattttttgtatttttagtagagacggggtttcaccgtgttagccaggatggtctcgatctcctgaccttatgatccgcccgcctcggcctccccaaagtgctgggattacaggcgtgagccaccgcgcccggcccagatgatgtcaattttgaaagatactggaaagtatgttttgggagggaagagggaaggaaagagtagaatatgaagtcagtaaaacctggatatttagtgccatctttgttacttactagtaaccttatgaatattatttatattgttgatccttaatatcctcacttgataattttagaaaatgttatgtacttcataggatcatgggtagaataagaaagtgaatataagtaaaatccatcatgaagtacctgaaatatgttgtaaacctaagttataatagtaattttattgttgctaatatttcagaggaatagccaccaaaccagtactacttattatttatttctatttaacatataaaacatataatattctttctgagtggtaactttgaaaagggacaaaaatattaaaaattacattaaaatcatgtataatttataatactcctttcaaggttactaaagtgtgcatgtatttctaatcattcacaaatatgaaaatctatgtgtaaatttttaaattttctaaaaaattgacaaataaaaattgtattattgtcatggtgtacaatgtgatattgtgaaatatcacatattgtgaaataaacattgcggaatgactaaatcaagctatagaacatattcattaccttacatacttattattttttgtggtaagaacacttaaaatctacttttagtaatttccaagtatacgttattgttactaacagtagtcaccctgagttacaacagataactaggatttattcctcctgtcaaactgaaattgtgtatcttttcatcaatatctcccaaatcaccccacccccaggatctaataaccaccatttttctctgtttctctgagtttgacatttttagatttcacatataagtgaaatcatacagtatttgcctttctttgcctagcttatttcacttgacatcatgtcttccagttcaatccgtgttgttgcaaatgacaggatttctttctttcctaaggctgaatagagttccattgtgtttatataccgcaatttctttaaccgttcatttattgatggacatttaggttgattccatatcttggctattgcaaatagtgccgcagtaaacatgagagggcagatatctcttcaaaatactgatttcagttcttttggatatatgcccagagataagattgctaaatcatatggtagttctatttttaatgttttgtggatcttccatactgttttccacaataattatactaatttacattcccatcaacattgtacaagggttctcttttctccacattctggccaacacttttcttttgtctttttgataatagtcattctaacaggtataagatgatatcttattttggctttgatttgcatttccctgctgattagtgaggttgatcatttttttttttcatatgcttgttagccatttgtatgtttgctttagagaaatatctattcatgtcctttgctgtgtgtcgatactgatatgtaaaatatgcatacaaaatcaaaaccataatttatttttaatatatttttaatatgtcattaatatttttcagtgtaataggatgtttttcataatatttactttaatggacgcaacatatttcattatgtaaaagcagtttattctatttggggagatttcgtttcactttttcgccagagtgacataattgaacattcttgtcataggtctctgtgtttatctctgatattcccctaggaaaattcatagaagtagcattttggagttgaagggaatgagtaatcttaaggcttttaaagtagttttatcaaattttctaaactgaagtataaagacacatagaaaagtacacaaatcataagaatagaaattcagggatttttaaaaaaaacttagtgtatccatgctactaccaccaagttcaagaattagaacattacctcaggagcccctctcatgttccctcccagttatgagcctctcccctgccaccaccctctcccaaagataagcactcttttgacttctaacacctagattagttttgactttgaaattactataaacagaatcatccagtatatgcccttgtatttgacatgtcctgctcaacattatttttgtgatattattctatgctattgcctgtgccatagttagtttagtttttctatgtatggtattctattgtgtgaatatgccacagtttatccattctgctaatcaatggacattgggctgtgtctattatggggctattaggaaaaatgctggtgtgatgttcctgtcctttgctgcatatatgtatatatttatttttaatatacgtggaagtacaatggctaggtcataagatgtgtacatttggctttggaatcaccaaaaaacagtttttcagtgtggtcatttcagttcattttcaccagcagtatataagacttctagttgatccacatattcatcaagagtatgtattttcaacctttatccttttaaccatttaggtgaatgtgaaatggtatttcattgtgttttaatttgcaatcacctgacgattagtgccatttttatatcctcttatgtgaagtcattatgcaaatcttttgcccattaaaaataatagttgtctttttcttactgatgtagaagttatttggatacaagtcctttgtcagatctatgcattgcgaatatctttttccaacctaaactttgctttatttttttctcttaacaatctttcctgataaatggagtttgatttatcagtcttttcctttatggctaatgctttttatgtcttgtttaaaaaataatacattaacctaaaattgttgagatttttttctatattttcttttgaaaactttatttttttgccttttacattgaggtctgcaaacaatctagaatttatgttttgtgtatgatgtggagagtcaaggttcatgtttttcaaatgactaatcagttaacttggtgctatttactgaaaagatcatccttttccaacttaagtgacaccatcgtataaattaggaaacgctatatagatgatttgttctcacttcaatcccacacaggcttaattataataaatattcatgtctggtggcaaacattcttaaacttcgtcgttcttcaaagttgccttggatattcttagccctttgcacttacatataaatcttaggattggcatgtcaatttctactaagaaatggttgctgcaattttgattgagattgcattgaatttatagattatttgaagagagggcagatatctttacagtattggactttctaattcatgaagaaggtagtcctctatttgtttacattttcttcactgtctcagtagtgtttgtagtttccagggtagaagcttaacttttcggtctgaattaccaaattactagcaacatatatagtcatgcatttcttaacaaatgagatatgttctgaaaaatgtgtcattaggtgattttgttgttgtataatcatagagtgtacttacacaaagatagatggtatagcctactgcacatccaggctatatggtacagcatattgctcctaggctacaaacctgtactgcatgtgactttactgaatactgtagtcaattgtcacacaacaatatttgtgtatctagacacagaaaatgtaccgtaaaaatacagtatacaaatgataaaaaatagtacagctgcatacggtatttaccatgaatggagcttgcaggactcaaagttgctctgggtgagtcggtgagtgagtggtagtggtgagcaaatgtgaaatctaagacattattgtacggtaccatacagtttacaaacactgtatagttaggctgcactaaatttatgaggacacatttttatcttttttttttttttttgtatttttagtagagatggggtttcaccgtgttagccaggatggtcccgatctcctgaccttgtgatccacccgcctcggcctcccaaagtgctgggattacaggcgtgagccaccgcgcctggcccatttattttcattaatgataagttaaccttagcttatagtaacttttttactttataaactttttttttaagtttttgactctgtaataacacttagcttaaaacatgaacacgttgaacacccgtacaaaaatattttatatccttattgtagcagctttcttatttttaatatttttgctgtttaagcttttctgttaaaaagtaaaacacaaacacgcacatgagcctaggcctacatgggtcaggatcatcaatatcactgtcttccacttccacatgctgtcccccactggaaggtcttcatgggcaatgaaacattcatgaaactatcatctcataggataacaatgccttcttttgaactaattaagaatatagtaaatacataaaccaataacagttgtttattatcattatcaagtattgcatactgtacatacttgtctgtgctgtatttttatataactggcagtgcagtaggtttgcttacaccagcatcaccacaaacgtgagagtaattcattgcactgtgacatcactaggtaataggaatttttcagctccattgtaatctcataggatcacagtcagtctgttgactgaaatgtggtgaatgactgtataatagggctccaaggaagatcataaaattgcttgttttccagaactttgacaaagaccttttacagaaactaatataatagataaataatagtataacattgctgttttcctttgcatttcattgattactaactgtctggattttttcttgtttattggctgtttacatttttgtcaatttctttttatgttctttatccagttttccagtagatttttcctttttttactcattaaaagatttttttatatgctaaaattattaccctgtgtctgatatatgctgcaaatattcccagttgtcatttgttttaattttgattagtggctttaatttataagtgaatacgcatattatattcaatctttttatattctttttttgcttctaaaaggcttccccacgccaatattttattccagttcttcttactatttttatgcttaacactttaatttttctaaaatgttttgtgttatgaaatccatcttaatatgtttatttctaaaacagacacttttgcttatcttaatattaaaacatatacatttgaaattaacattcagagattgaaagaataaggaaagtaatcttgtgtgaaattaggtcaagatgtgcttagatactaaattaacacataagggaattgaatgtgtttgttttctttcaccacagggaacatgttatatgaagagcatggttttataatacataaaaggattattagaaaaatgatgtattttaccggtcaggtgtttgtgtctatactttgatgtgaatgcaaaatagtaaatataaatgtaaattaatttaaaacacatagaatctgatacaaaccttaatctttttccacgttatacattactcacacctgttatatttttccgtgaagtatttggaatactctcgattcctggaaactgttttaaagtgcagaagagcacaaaaaaaatatgtgttaaaagttcttgatttccacccaaccattaagtgatattgccaaagaaaactcttcagagcatttttcactgatggctttagatatgttataccagaataataatgattcattattaaaatatgcaaagtgtaatttctcaacaacattttgtggtaggaagatgagctggtacagtagttttccttattaaataattttttacaaaagtaattgacatggtttggctgtgtccccacccaaatctcaccttgaattatggtaatccccacatgtcaagggtggagccaggtgcagataattgaatcatggaagaggatcccccatactgttctcctgataatcagtaagtttcacaagatctgatagttttataaatgtgagttcccctgagcaagctctcttccctgctgccatgtagaatgtgtttttgcttctcctttgccttctgccatgattgtgaggcccccccccgccatgtagaatggtgagtccattaaacctctttcctttataaatcacccagtctcagatatgtctttgttaacagtgtgagagcagactaatacagtaatgcatttacattgttcaaaatataaaaggtacagtaaaaaatatctcaccctacccatcatctgctctaccctcactgcacattaaccttaattctagaaacaaatctacaaaataaattcctgggaataaaatttccaggtcaaagtttacatgctttttatagatatggccaaactgccttccacaagaggtacacaaatgtatacttcccaccagccacgtagaagagtctgcattttcccacagccttggcagcatagtgtacctgcagacttgaatttttgccagtgcaatagatgaagctctaattttcatttctctcattattaccaaggctaagcttctgttcatgcttttaaaatcctttgtattttcttttctgtgaactgtccttatcttttgtccaattttcttttgggttgttggcctttttcttattactttgcagaaggtctttcatgtgttaggaaaattagtcccttagacatgagtcacaagcatttatttttcataattgttcatttgtttttgattttgcctatggctcttttggtcgtgcagaagcttttgattttttatatagtccagtttactgatatttttgtctgttaattaaagttatttaacttgaggatacaatttacatttttttgtggttgactactatagacatatactgcttcttacattgaaaaaataataatcctgaatttggaaattgtttttaacaaacttttggtgaaggtccatcatatttaggaacagagcttgtttgacccagaaatcaaaggtcagtgagaaggagcaatgtaaatagaaagttaaatagcatgaggtaaatgttatgatggtgggaaagacaagatctgagaggataaacctaaagcaacatcataattaagctgaaaatttcgtctcatgataagctatcatttcattattccagatattagtcaaatctgacccattacactgttttctgtcaggaattgttttacctctattacaaggaagggatagtatgggaggatgataaggaaaccagcagtcttagttaaatgttatacagatttctgtgcttatatatgaagcctaaatgaaacgtgaacaatttcatgatcagataaaaaggagttcatcgctcagttttagagattttaggaaaatatgatggctattatctcagtagcttcagagtctagaggcatttagatgttgttagttgaagctgtaaaacgctttttacatctacttgtgagtagaaaatgatccaataaaaataaaatgtttagttacctcctttaaaatgcttgaaaaataagttgaggacatcattagatcatgtattacagacgtaggagtatatttgtaacatcacctacatcacacatacctgtgtgcgcgcgtgcgtgcacacacacacacacacacacacacacaagagttcagcaccacaggtgtagttatggatgtgaactcacaaaacacaaatcaagcaaagagaacaatatctcaattcatgattcatggacattctgtgctatctgaaacacaatgcttcttttgcccaactctcacccacacagggaaaggctgccaggaatgagaggcaagaagtgtgcaggtcaccttcaacaggagccaccacctgtatttcccatcagtcttttacaccattgtagtcacgtggatccaaggactgtattccaactgacagctcctgcgatgaggtgcagttccacacgacaaagccaggcccaacatttcccattcatcttaaagttagtgtttccaaggaaacagtgctgtgggagcctagggtcagtcccagactgacctgcaacagcccaggctggatgttaatcctttgcttatacagtctcatgaatttttcacaacatatatacatgcatttacaagacgtttcactgtacatattgtttacgtatacaatcttgtttaaaattcatttttctgtacattaattgatttttttctcgacaactttctctttttcatctcctaactcttgcatccaattaaacaatgtactgttcattagtgacttattttaaaagtatctaaaacaattgttccaaagcatgtgacattgtttatgtgacacactggtatattatctagtttatttttaaaatcttctctattattattcataatatattattatggaacagatgtatattataaaattttattcatattgcagtgtaatattttgtattacagtggtattgttaatagtctcgtaaagagctatcattacaagtttaaattctttattctgggatgccagttttaactcttgatattctgaagaaaatagctttactcttgtttattctggctctgtttttttgttttgttttgttttgttttttgttttttttgttttttttttgtagagatgggagtgttgctatgttgtccaggctggcctcgaactcctgggctcaagcaatcctcctgcctcagcctcccaaagtgctgggattacaggcaagagctacagtgctcagcctatcctggctctttatttacatgtaagcttgagcaataatcactgctacttaataactttattgtcattcattatcatgcagagtattgctctaaggtatgttcagggatgacgttactgagtcctaacagtaatcctatgaagcaggtgctatcattgtccccaatctacagaggaggcattgagagttagagaaaacttggctaaaatgttaggcaagaactagaaccagaattgaaatccaagtggcctaactctagacctcacaatgcttaataccatgtcatgctgcttcctaacctatttaatgtttttttcaaccccaacgtcatcacccatgtgtgatagtgggatcataataatatctatgtcgtagcattgttggatggattaaggaagtctacaaatgtgaaacttccaaggatgatggttggcatatactgatctcttaataaaaataacctataatcattctgttacagtctactctaatccaaatgttctttttacttctcatctcaaccacctgcttctgtttactaggactcacaaactatagctcacaaaaacgcataacttaccaattttccttgtacatgaagggacttccttttacaatcttccatgacataaaagaaagctagaagcaagtatagtagaagaaatgattgctatacaaacaaaattatagttggtttggttttaattttaggatgcgcattgaataaaaatcactcatttgggatttagaagacctgtgttatatatctggtgctaatgctgaataacttggcttattcatttttataactgcaaaggaagcgcgtatggcatataatacacaacacaccagtatatttagtaactgagtgaataaatgaaagatgtatttctttactttatcagttgcagttggctatgcctttgtgtaaggtgtgtgttttgaaattccaaaaaggtattagtttctttaaagcaaagaatttttgtagcaggttaatgaataattttgaatacattggttaaatcccaacatgtaatatatgtaaataatcaatattatgctgctaaaataacacaaatcagtaagattctgtaatatttcatgataaataacttttgaaaatatatttttaaacattttggcttatgccttgagaattatttacctttttaaaatgtattttcctttcaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggtagggaactttttgctttaaatatttttgtcttttttaagaaaaatggcaatatcactgaattttctcatttggtatcattattaaagacaaaatattacttgttaaagtgtggtaaggaagactttattcaggataaccacaataggcacagggaccactgcaatggagtattacaggaggttggatagagagagattgggctcaactctaaatacagcacagtggaagtaggaatttatagccaaggagcagtgtaggagtcagtagatggaaaattattaagaggaaacatcaggggtaagtgggattctggctaaaccaacctcacaggattcttgctgaagataggccagggttatcttatcagacaacccttggggaatggtggagaatactgagggtgatcaggtaccaaggataaagggttcttgtaaaactgacaggcttctttgctgaacctggattttacaggggagtgcaaagatgagcccaggcgaaggttcagaagcctgactaaagtttagtcaagcagggaatctttgtcatcatcatcattgttgtcataatgataataattattattattttactagaatatgttgctttttcctcagcatttactagaaataaggtcttcattaaacttatgttactagaatgcctgcatcatatttgttactgtgattcattttctatccctgttttaattgtgcttaatacatattcatagattccttatccaaaattgaagttgtttatgagattaggttcctaaaatataatgtctgggctcttttgtagacattgtaaagccctctcagactgactacactttacctttctatcttctcattctgccagcaatctccccgtatagtctggccacatcaaattacctggtacctttccatccatgtaatttcatgtcatacctgtgatcttggttttctctcttctttaaatgacttctttcagtttattttgatataatgaattttcttccattctttaagaatgaattcaaagtcattgcgtcttccaagttttcttccgtaccccaagtagagttagaatccctgttaggatttcttataaacctttttattcatctcccattgttcatatgttgatttacacttaaattttatacacctgagtatttcattacacatctgcactgttctttgagtgcagagggcattctcttatttatctctgcttctccactcatatcatacacactcagcctaggatccagtaaatgatgcttacttgtgagtgtttttaagtcaatgaataaagacagtaccaagacacccagaatacgaatgagatactgcaggtaagcgtaaggcttcagacaatcctgccaattgaacaccactatctccttcttctagtgtccttgtaaatgctgattgatcttcttttctccctttcaaggaatctattccaaagattctttcaatatgctgccccgttttgcgtctccttatttgccaaaatctttaagtagccaatcaaataaaccgaatcgttgaaattacaatctattaatgaatgtattgttgggcaacttcagagtaaaaaggataagtaacatttttgagtagttttttcttttatttaattgactttaattgttaaatttatttactgtccagtattgtaaaaacctaacattttaatctccatttagctgttgttttgctggaactgagagcaaagggaaaaggaagtttgagaatattctagtgaagaggaagtaaaagtttcgggaagatgggcatgagtaacaaggagatagagggaagtttgctacaactaaaatgagttagattagcaaaatgttctcgactatgtttaccttacttcctcctgacacttatgtctaccattctgatagctactcctcaagagcagatggcactgtggaagtcacaagtagacatcatttcactagcacaaaactcagcctgctcagccagtggcacagtcttgggttcagtctgatgattaaatttacgagacataataggctttacccagtaacaaatttagttagctttaagaaattatacaggatgggtaacaacagcctgcacattaaaggcacagtggaagtcttgataccaagacgtggcttctgatgtcccatcaccctgaattttagtcatacatgatcacaaggggcaagactgggtgcgtacaaaacacatcatcgtctcagggaagccatcagttctaggatcctgaccatttctccacttagctagtacatattgtactcagaggtgtttgactagctcctattcaccagtacaattacatctcatgaatactgatttttcactgctcaataaacaaccccaacaagaaagtacagttacttggcccaatacacaataaccttagccaaattctcaattatcttatatccagtatattcttaaaaagtaactggcgtaatattgcgaagaggaaaggtcataaagtctttcctcccaaccagaaatagctttttgtagctcacggtaaaagcacattctactcttttaaatgcaatctttggttaaaatgtgcctctttattataatagtttaaaaaatactcaatgctagctatctctcttcctggaacacatttaagaaaagatttttttttgaatcccttggtacaaatagatcctgtttactcaatcaaaatgacttttgtcccagtctgtgccccccggaatggttttcaaataatgaaaacctgcattgtgtcttcgattgtctatggcccatagggctctgccaaatgggtccctgcagtttgaagtgaaagccatactcggctgtgttaatcacttttctttatcaaagctacaagtcaccactcactgctgtgtgtagtttctgagagtcatgatatttgcctcctgcagcttgttttaaatcactgaggggagagggagctgcttttttcctggcagaaaactccttggcttcagtcctctgagcacattccgagtttcttatctctggagtgcagacttcaaaaatactcttttagcctttttcttctgcttgtggctgtgttcaaggtggggggaggggaaacataaaatcatagatttgatgacttgagagtttctcccaaaaattctcaaacccccagcttataattaggaaatggtgacctgtgtgaataataatttaccttgttttttatccctctttgtctagcttccattcctttcactaataaatgatttattaagattgcacagtttttctgatttaagatataggatattagtccttacagcctgctgtattcctctgcttaaaggaattaaactatttttccattaaagaaagatgggacactagactttgctttacttagtttcaaactactgaacaccaaaaataaaatttttaaggagttttgagcacatgcccttttttttaacacaaggtaaaaaaaaaaaaacacctttactaaaatcttaagaaagagttaatgcaaaggaagtagatatacgaacagccacgcccctagctccaaatcctaaatgtaaagaaacttgccttgtctggccatggtggccatagctgcctcggaaacaaagggtctgaggccttgccattcgggtagtttgttttctctagtcaaactctgagcacacctgttagaaaaatatgtaataccctctctctgtgagcctcagttttgtctgcttggtacttcactcttattgatgaaatgcagctagctgtgtagtgaaacccagataaaaaaaagctttaagggctgtgttctaatacattgtttatgctggagtgaaaattgactgcacattgcttggtttgtgcaatttactcccgaaatattcctattcaggaaatcctgcaaatagcaatattcatcttgaaaatcacctcacagaacccttagcaagctgagaaacataatcaatgagatcgtgatgtagagggtgaaaattaggcgtaatcacagccctttcccatcagtcagcccactagaaggcatgcctttgaattttgattttcaaatatactctcaatttagacataaaatatgttgatttcagatttcagaaatgataattgaatgctaagatcccgggaccagtttagaatttctataaagggtcttatgtttttaacctttaatgaatgctttcaataatgagctagaggtatactatttatctgacataagactgactactgctttccaaactttttattaaaatatgaggtgtggcgggacacataattttatgttaaggcttagtgactgaaatactttcatcttaatcacagggagggggttttttcctcccctcaagaatcactttccttctgtggtttataaataaacatgacatgtggctctgctggctcttccttgcagtataaggagcataattgcccataatgtcaaatccacactaaaaactaccaaaggactcaattgtagtgactgaccattaaagtcactgaacactgtgtgtgttcacattgctgtgagtgttgtcaaagaaaaatagcactagacaacagacaagaaagactgtgttcaaaacttttgcaatagaggagacagattgaactcaattctgctgaaataaaaggcaggagagcctctaagtgctgagatgagttagtgagaaagtactagatatcaggagggaggttagtcaatgtgcttatttaggccatctgtgtttgctgattggcacttatcaaagttagattcctatcctcccaacagaagactagcagattggggcactatcttttttgatgattctatatcaaagtgctagctcccaagtccttgagaaagtttattcctgaggtataaaagtggcaagaggctaggagaatatttttgtctcaaaaaagtagagaaataatatataaagttttctagagtaaatgctctaagaaaaggaaggtcaggtctaaagtcaggaagaaatctgtctcaaatgtagtcaaactcagggtatttttaaagctttctttgtcaaccctccattttgttcaagggaaaccagttttcccattgaaaaacttaggaacgccagttcatctagttcatttcagcaggtttctgttgttgaaggactagctgaacgaactctgacacttggtagtaatcagacatttcatgaaggagatttccatgaaagttagaaggaagacgaagattaatggttgaagcagactgcaaactcagtttttgagtccagagggcagcaagtcaaaaagattcctagaagctgggctgtaggcattctcagatggtagagtgaggatggcagtagcaatccgatggatttcttggagcatggcacggaagaggttggagtttactgaactttttgcatggcctacaaagcagcagctccaggcatgaaagttgtctatacataatttgctgtggtggtgagtcctttgtagtttatagcaagtcatccagcttctgcttgcagggcttctttagatattgtggggaaatggcagctataagacaacctagagaagagagtccttatctcagtaataatatgggcagtcacgttttagttctcagtgtcaccaagtcaggatggtgggagaaaaatttgaaatgttaatttggagaatcgcagccagattgtaaaggaaataaactgaaaattggtaaggacggacaaaatgtgtaagacagcaggatccagatcaatttacaggtaggtaaaaaaaaaaaaaaaaaaatcatgtcgtttacaaagaaatgcaaaatagatcaaagacaatgaacaggactagaatctgataaccccaagggttactgaaactctatctctaccatcacccttttgatcagtgttaatcaaagtaagactttccttgtttataaaataagactggcctatttatttatataggggtagcaaaaatggtaatttaccaaataggctattttaagtgtgattagctggaagttttcatgaagaatcacaagctgaataagtttcagagatatactgtacagcatagtgcctatagttaacgatactgtactgtacaattagaaatttgctgagggcagagtttaagtgttcttaccacaaaatactactactctcttttaggagcagtggtacataaggtgagaggaaacttttggaggtaacgcataggtttatggcatagattgtggtattggttttgtatatatactttatctccaaactcatcaagttctatgcattaaatatgtacagctttctgtttgtcaatcatacctcaataaagtagtttaaaaaatatgaaacctcagatttgattttttaaaagtctccaaagtttaggaaggcaagtcaagaacttgacatcagattttacctgaagtaaaatacctatagattcagctgaagtgttctgttttccaggttcctaaaatacccttggtttcctgggtctcctaagaatagaccttccttactcagttgtaagattgggaattctgtaagccaggtaccgggacagttttcccaaaaggggcttatattagctccatatagtcaagagtagctccttaaaactggtcacatctgactctatgcacttaattctcaaatatgacattccagtcaaagccttggttatatatttttttcaattatgtcttgttacctaaatatatttattgagcctatgcaaataattatattgccatgaaaataagaatactcggtaagaatttctgaattttacagggatcaggcagggataaaaagattaatgtttcattctgtttacaaaagcatactctaaattctcatgagttatagataacttaagagaaaaaggaaaggcgtttcttgtatttagcaaacagaacattaaaacatgaggaatattttaaacaaaagccataatcaaatcttttatcagttcattcaggcccatgtagttaattcttgtcttgcttgatcttgagttagtagtttcatgaactcatcagcttcttcacagagtttcataaatcctgactttgtccaatggtataatctcgaagttatttaagcaatggcatcagaagtctgtgtcccagagtacctgtcgtagtacttcctatgggtctcaaagatggtcctgttttactgaagatgatgcattctgacctctaactgattgtaagagcactcagggaagcatcagcataaaccaaaaactatctgtgaacgacaaaagacttaaaatggccataattaaagatctgattcattcgacaagaaattttttttttccctggtgccatgccacattttaaaataacaactggagttaggactgatgacataatattattatcggataaagtagcaccaggatgtgtcatggacacctagagcacctagagcactaacaaagttctaaggatttattataatttttcaagtatttatactaataatagttgacccatacaactataacctagtcaaggttcagcatctcttcttgtcaaagctttttatgcaactcaacataccaaatgaacctagttatttttaacatccttcattttacaagggtgcaggaacaaatcctttgaaatttttcaaaccaatctgagattaaaaaaaattttatttaagaattgacctgggaaaagcaaaatatcaaaggttgtaaaatgacaaaaggtttgaatacttggctgaataggatcattgctcactatgaaagaatgcatggctacctatgtaaccaagatgacaataaaagatttcaaaaataaatgtagaaggccacatgacggtaaaagtttttagttctttccaaagagaaaacactactttctaaaaaaattcaaggacatacaaaatcaacacaggtacttattctgataagaaacaatatttgtttcctatacagattacccaaaatataaaaaaaaaaacaaattttgcaatctcttattaagagaagaccaatagaaaagatgaaaatgttaattagtttgaccgaaataattgttttgcaattttgtgtgtgcgtatatatatatatatatatcaaaatatgttgcatacttaagtatattcaattttatttcaaaagagcagaccaataatccaagaatattttatcattttttaacaaaaagaaactacaactcatttttgatcaatacactgttgatactaagggtcatttgtaagagtttacatacacataaatccattccgttttagccagcattggctattaacataagactctccttccacaaatcttctgccatttccaatgttcattcagattttgtcctataccttcctcttcctcattttcacagtcattttaatttaggacaaagttattctctttttccttaacaaaaacacatccaacataccttgtatattttgcatacaaagttgtttccctttacccctaatgtttctggaagttttatttacatatattgattatatttttaaccattagtaagtcttattttatagagaaaactaggaattagctaagtgtgaactgtttgtcatataccagtatttcatagccaactagcaaagcttatgaatacaagttaaattcacctactcaatatgagggctaaaagtttacatcaatatttgtggaggagccttttaagattttcttttgccctgatatgtaatttatggaggctgtgttctaaaatttgagtaaatgactgaggagatacctagtggccatctgggtatctccaaatcccatctgaacgtacacggtatccagtctgtttccaattagctttttcaacctcaggtggttgcttctggggtttgagttttccagagcccccagtagtggcagggagcataacgctttagagaccatagagagttgagagactggagtaggaagagaaaggtctgtcatggatggacaaagagatggagcaggtacgggtttgaagaggaatatgctgaaggatttaagggagctaaagggaagatcaaaagtagtcaaaggaagaaggaggaatggtggtgatgggaagggagaggtcttagatgagccagcttagggagtgcttatgttttcggaagaggccattgaagttcatctttagtaaaaatcaaactaacaagaagagaagcctagtttgtgccatagaggtgaagcatctaatcagcagtagtcttcagaggaggagaaacagaatagtgagaatgtctcctggaggaaagaggcaccgaaggaacagcaacaacaaaaaaaggaaacatgaatgaggtctctacaaacgtgatctgtacagaaaatgatttctctaaatactgaaaatctgaagttgaaccaaatgagatttcaataagaattttccatgttctaaaccaatgatgcttttcaaacaaagaagcctgggactctagactcaagaatatactcagattactgagaatcaaaatctgatgttaccatgcttccacgctttcgtgggtaaggagtcagacttaccaatggattcccaattaatcagtcaggagtgtactcaacattcacaaaattagctttgcagaggttaatgtcattaaattcactttagaatggataattcaaattcaaatagtaactcccttagatagatgtgtactagctcaagttcacctgttatctgatttcatttttaaaaaaaattttttaaaagtggtgttcgggaggtaaggaacaaggaagagacctttagaaaaaagtttcagtgttttatattggatatgaaaatatcagtggaatgtgtcctgaaaaacactggatgacagttactggacaaaaagacaaattattcccttttaccatgcaactgaacacagatttattgaatgtttttctcctgagtttaggttgcctctgggcaagagtataattctggcttgataacaccttgaagcgtgtttgtttaagtttgtggatagtttcatctattagtggaattaggcatctgcttctctttatgaacactgggtaccataatcttcctcttactttttgttttttctactcaactccaaaaaccattgctgagttgaagtagaataataaggggaaagaaacaaaagactaagtttgaatcccagtgctgacacttactggctttacgatattgtttaactcacttaccctttttaacctgaccttcttcttcactaaaaatgaaaaattgagtgaatttccctgggactctgttagataaggcaaaactaagatgggaacacatttcctaaggcgtagaaaaagacagtgaatgggacctttcttgttgtatcaggagttatggtaagaggtactaacaataaaaattaggctttcagccaggcatggtagctcacgtctgtaaccctaggactttgggaggccaaagcaggtggattgcctgagcttgggagtttgagatcagcctgggcaatatagcaaaaccccatctctactaaaaatagaaaaaattagccaggcatggtggcacgcacctgtagtcccagctacctgggaggctgaggcatgagaattgcttgaacccaggaggcggaggttgcagtgagccaagatcacaccactgcactccggcatggggaatagagcaagacttctttaaaaaaaaaaaaaaaaaaaaaaaaggccttcaaaatacccctacagcagcaagttggtaccagaaaaacactccaaaaaagggagtagatggtcatgagattttcatcgttcaccaacctaacttgcccatataaggaaaaggataaacttgagaacagtttcttgaatgagaattcctggaacagatcattcaaataggactaacaatttgttggacatgagaaaacttctatgacttttactgttccctttcttatgagggaggggagaagagtgcttttcctctttgccaagccaaggaagagggcttcaaagaacctctattatagtggcattcagaccattgtatttataaaaaataaaaatattttagaaaattgaatatctgcttgcacattttaaagatgacatctattttctgcccttgggatacagtaaatattgacattttaaaagggtttatagtacagtttagaatgtatcccgtggaatccaaataccattgcaatataatgtctaccatcatatacttaaaaatacatgaaaaagctcatatttaataaatagaagttttatattattcctttttatttaaatcatatttttcaacttccccaatgaattgtattctaatgtgataaatatgtgatacatatttatgctataaagttttattagccactctatcataattctttataaaattatatttatgtggacttaaattcaatttttaaaaacaatttcctgtgactacaaggctctaagtatttttaaaattctctagattgagtagtatttaaagtattaataataaatacacttagtaataaccaaataacctaaatatatgtaccttttgataaataattattaaacatactcagtggatagttattgaaaatgaatctattatgagatggatgggtatttgatggtaccttgagtaaagaaggatttcagtcgctaatattttgaattgtacttttatttggcataaatgtatcttgactacaatgcaccagtgggataggtcagagaggtgtgcttttattttgtaaagcggaagaaagtctgtcattaaccaaaaagtgggcaagaaaattggaatgaagtgcctaccacaggaacaaatccagtcaaatcttttttttgtttgtttgtttgagacggagtcttgctcagtcgcccaggctggagtgcagtggcgtgatctcagctcactgcaagctccgcctcctgggttcacgccattctcctgcgtcatcctcccgagcagctgggactacaggcgcccgccaccacgcccggctaattttgtgtatttttagtagaggcggggtttcaccatgttagccaggatggtctcgatctcctgacctcatgatctgcccgcctcggcctcccagagtgctgggattacaggcgtgagccacctcacccggccgcaacatgctgttttaatgagcgcctgggtgcgggcagcctcaggcctaaaatggcgttagccccaagtgaggactggacaaaggttttatagtctcctgtaaacaggaagtctcctggcctgacgtaactgctgcattgtacccggatggcctctttctcgatcttcagaggtacttgtcttctggccggctctcttcctgcttctgctatttcgccggtgcatgctgctcaggcaagtagccttgtgccttaggaatgggcctgagaaaggaggagttactcatctccttaagctttcaggcccgggagagaatcttacaacccactgatgagttatgaaatccatttaatgggtaaaataaaatagaataagatagcatagggtaccaaagaatataacgcaggttattacattgtgttacgtgtggtatgcttaagtgttgttttctggaactgttgttatcatttgtattgtacttcatttttgtttcgaattttaagataatctgcacagttttatagaaaatgagttaattagtactgtatcagtgatgtcatactgggttaattattacaaagttgggggtaaatttatccctgtataacagactttaaagataatataaataggccaggcgcaatggctcacacctgtactcccagcactttgggaggctgaggcaggtggatcacgaggtcaggagttccagaccagcctggccaaggtgatgaaaccccgtctccactaaaaatacaaaaattagctgggcatggtggtgagtgcctctaatcccagctactcgggaggctgaggcaggagaatcccttgaacctggaggcggaggttgcagtgagccgagattgcaccactgcactctagcctgggtgacagagcaagactccatctttaataataataataataattttgtttatttattgaatagatactttcttccagtacaaaattcaaaagcattgaaatcctctgttgcattgttgtctttcagccacacagtttctctccccatgtgctgccaaggttttcagtttcctgggtagccttccaagaataggatgtaggtgtgtgtgtgtgtgtgtgtgtgtgtgtgtatattattttctactcttgtcctcttaaaataaagccagctgttagaatactataaatactgtttctgcatccttcaaaagatggttcttttgaagcccttttccttggcttggcgagggcagaaggaaaagcactcttcttcctccttcataagaaaggaaagactaaaatgcctgtgtgtgtgtgtgtgtgtgtgtgtgtgtgtgtgtatagcactcttctccctcccttataagaaagggaagagtaaaatgctgtgtgtgtgtgtgtatatatatacacacacacacacacacacacacacacaggtgattattttctgtattagtagttaaagaactgtctctttttttttttttttacagttgcatactattctgttctaaggatataccataattcacttaagcagcactccaattagtgagcctttagtttgtttcgacttttggctaagataagaaaatgtataactttgtgcacatcattttacacgttgcaaatatatctatgtgataaattcctagccgtcgaatggctgcgtcaaactggcatttgtcttgttagtacattttgccaaattgctcttcatagaacatctcgtcagtattaggaaaggtttcttttccccatacccgtgcccactcagtgtgttatcaacctttttgatcttctaaacaagaaaaatggtgatatctgtcattttaatttgaattctttattcattttgtgagtgaatttgaattttttcatgtgttgcagaatcatttttatttccttttctatgcactgtttgctacttttttgttttttgccaatgttctcttttgggttattggtctctttcttactaaggcaaatatagtttacaacttgaagtaaaaacatggttttctatgataaaggttttaatgaatgttttctacaacagacagattctagtcttaaggttataacctgaaaacatcaaaactaacctttgaattgcataggaatggtctttgctcttcttagccatcaatcctggacagaagttcaacatgatgacaaattgtagcacaagtagagatttaaaaaatttttaactaatatgtaaatatttgctttcattttcttatttatctaacaatacattgatggctagaacagggtttgtctttgcaaagagcctgtgtcaactgactcccattctttcaaaatacattacctaaagaaggtttgtggcttctctttgcattgcattttctagccaaatctgaaataactatctggaagcttaacattttattcccacacttatttttccttgtgaaaatcaaaactgcactttcccagtcttcatgagtaaccacaatggtttgccatttgacttgccagttgtattagcatactgagatgtaatttatctgcatcaagagagttaattctgagcagctgggggctttctaatctctttacccatcttggacaccagttccctctcactgctatttgttttattctttgcagttagaataccattcctcttgacatacaagaaacaaacccaatagaaattaaaaggttccaatttctattttccattcaccaatattataccattttctcctaaagcagttctactctctcctagatcattctcttgcttttgaaataaaccttaaaaagtcattttgtcaccctaaatatgtttatactttcttgaaataatgcttttactgcatattagaattttagtttttacttagcagtccttcactactcctttagaaggaaatttagataatactttgaaggaagttatgagagaacgtcagaagccatgctatcagttttttttttttatgtactctaaagaaaactctgctctgcccatgggtgtcatctctttctgattctgtgtggaggagaaaaatgggaacacttccaatcattttcaaacaatttctgcttaagtggatgaatggaccacctggtttactaactataatgcccaggggatggctttgattggcagacagaacgcggtgcagaaacaatggaagttaaatgaggaaggttttaaacttgcaagttacctcccttggtggcattgactgttggtagaaaataacacgttgggatttcagatacattcagacatgctctgcacttgcaatttgcaatacttaaaacaacacaattcttctaatcataactttttaaaaaatttggccacctttctccattgtctcataaagctatattcatgaagctgtttattcacaaagtcgtatcatttaaagataagtgttatatccataagtatgtaaatgaattaaaatctgggaggctaacacttatccattccttattctactatatcctatctagagccatgcttcttaaaatttaatgtgaaactgttatttctggtctgtggaaccacagtttgaaaagcactgtcatagattcttaagtagatacattttcatgcatacaataaatatgcaggagaagttaaatgggtatgtccgggagtcaaatattgattctcagaatgaaaacttcttcatttatttctcagtgatcttcataaccctttcccatactgggcagtgagaaaaaattatcatctcactctgaaatagtgatttcaccagtctctttttatgggttgggacctcatggataatgaccagtcttttagatttccttgctctcctcctgctcctctccaaaatggcagctgggttgacagatgaggaagcattatacatgacctgagatctctatgcaggtacttgcagtctcctctgaccctctgctctctggaacagtgcctcttgtctgcctgataagtctctaccctgctgaccttgtggctctgagcttgtattttcatcaggaaatacggttctctgctgactatatcagttactaaagggattcttaaatctctgagttactgctgaagaacacttagaattctaaatttgtaattatgatacctctaaaaacaagcgtgattatccattatgtataaggatgccttccaaaaagttggagcaacttgaagccacttgttacattgtcatttagtggaggagggagtgaacttggtgtttacaggtagaactctctatcaggtgctgtgaggaaaaacaaaagcaagataaactgtggccataatctttgttactttatttcccaatggggagaaaaagacaaatatatatatttgtcaaaactgaacagatgttatttgaacattatactgtatatgccattataactataatgtatataatacatatatataaattattgaacactaaaaagaacactttaagaattatctattttattttttttattatactttaagttttagcattaggagaagtatctattttaaataaagctatttcactcttcagtttccatctcaagaactcataccaatttaaacttccactcatatttgagagttgagaaaaattaccaaatgataataatatattatctaaaaaataatttaaagatgcatgtctctaacaaaactatgtaacattctgaagggttttaagtaatacttcatatatcctaattcagaataaacttagatgttatcagtatgaaaatatatcataaagtaacatgattctctccaatgaagatgtaatcatccaaactttatgcgttgaatttacggcttagaaatgccatagcaatatgtcctcttgaatatacaattctatatactgagatttcacttagtatattaagttctgtatcactgaagagtatattatgattctaattaacaaatacaattctattttatataagtacccctatcatctactaggcaaagttagctgatgttactatgcatttttttgtcagctgtactcaacttataataactttgtattccaaatacttcaaaattgccatatgcttactgttttcctattcacatcattttcccccctattcttcctgaccctcctttgagcaatagtgtcagtgggattagactcatgcattcacatactgaatgaatgaatcagtatgtgattcatgatatagaaaatttaaattccttatatatttcatatatcatatatatgatatatgtatctgtgcatataggggatattaaacacttctctgtatatatctgacatatattttgaaaaggaaacaccgtagggccaagttaactgcttcaattattacttagtgtaaatgcattcagtttgttctgtaatttcaaaatgatacatataaaaaagtagagtttgcatgtttaatacatctgaagctacagtttccaaattctgaacactttggtgacccccttgacacaatgaatatttggcagttaccgaacataacagggcacaaataatatagttaatgaaaacatccataattatttaaattaggctattttaagaaaagttttaatttgaacattaaacagcttaaaatcatttataataattgattatgtaacatgctggtcattaaaatgagattggtattctctttttttttttttttttttttttttttttccgaggtggagtcttgctccatcacccaggctggagtgcagtgctgcgatctcagctcactgcagcctccgcctcctgggttcaagggattctcctgcctcagactgccaagtagctaggattactggtgcccaccaccacacccggctaatttttgtatttttagtagagacagggtttcaccatgttgaccaggctggtctcaaactcctgacctcaagtgatccgtcagcctcagcatccgaaagtgctgggattacaggcgtgagccaccatgcctggccaagattggtattcttgacattaataattttggtaagcattaagaaggcaaaacatggaagcactcacaataatgtataggatccaagtaaaattctccttactgaaacatgaaactacaaagccatgtgcgcatacttttaatttttaagatttgtttgaaggaacttttgtgaatgacaagtagagaaagtgtggatagatagcatctctgtctttaaaattatttgatgaaataggtgataagaaacacaaaaattaataattcatgtgacctttattacaatacgtcttctggtattagcatagtaataagtattagtgatttacataattggagagataacacaaatacaaattatgcacacacacatacatacatacacgttcctgtgcttcactcaaaactgaacagatgttatttggacattgtactgtgtatgccattgtaactaaagtccaatttgttagagatagtattgttattttattatctttagtatcttcaatgagtccattatgaatagtagcattaactttgcttatgactagcttaaatagaactttggactccataaaaatacgaacaaagatttttaatggctttagaatacagaagtaatctggtaaaagtattcttgattttaatagaaaccaaacaatcaatgtgcccgttagattaacagtgaataatcagattgttccagctcttcactaatgaacaatgctgaaacaacattctctgtaggtctcctcagatagacatatgagaacacctagaagtggaattgttacctcattagagtattcacatttttaattttatcatatattgcaaattgcttttccaccagcagcaagaagtggcaggaatttattattttaatttgcatatccctggttgaacaagttttcaagtttgttggacagatttttccttctgtgagttgactcttcatatatttaccccaattttccgttggattgtttactttctcttaccgattaatatgagttgtctgtatattctagattctagtagagttctggattatatgcacctaatatataagtctacaattccttatccaaaatcttatcgttgacttttcaggagactagtgaaaatggctacttagtggaacatatggaaatcatgagttataagtgtataaaggctaagtgcaacagtctaaagacctggtatcacagatgaagactgacatattgagtaaaccaggaattggctttattacataatgtgtcctttttcttgatttcagaaacccatatatttgctgtttcctgtacatgtttaggaagagtattcagaagagagaatgcagatatattgttgctgtttttttttaaaaaaatacgagtttaattcaattacccatttgattgcttgagtttattagttatggtagcacttagaaagagttgttttagataatgactatgattttggtacagaacctaatagtaaaaacaaaacatctttaattttatttaaagtgcatgtcagtcatgaagtcagaattgaattgctcttttctttgcttttaatgaaaattagcctaatggctgttttatctttaaaaagcaacttctagtgtttaataataacagatttaagtaaatattctgttaagacttaaagaaccatgtccaattactatatggataataacttagagatgctctatattggtttaaaataatgcaaatatcactggccactattcagagatatgtcaaaatcacttttgtttaatatgtgcctttctagtccttagatctactgtattccctaatccttttggggtatataatccagagatattaggacccattcagccagaaactgaaacatgccatgatggttagaattcatcagaaccacactcaaatgaatgttaagagacatagcgtgataaaagtgcatctgaaagagtatatgaacagatgacattacatacaatgttgtatataagagaaaggaaggaaagacattcatatcatgtcatattaattcatgtacactgaaaatacagaccgtgaacagacattctttcatttgttccttcatgtattcaataatagaatgcttctctaccacagatgattccaggggaatttggcaattgctggagatatttgtggttgtcacacatgggggaggagaaagtgctactggcatcttgtgcatagtgaccaggcatgctgcaaaacaccctgcagtacacagggtagctcccgacaagaaataattatccagtcccaaatggcaatagggctgaagctgagaaaccctgattgaaactcacattacatcctaatcgaaactactttgttccgttctgagccgtaggattcatcaaataaaacctactttttattggtacaatatttaaatccagagaccctgtagcatagtaattatgtatgcaggatttgcctcagaaagactagggttcaaatctcagattcaccatatgttaggttgtgccctaggcaagtttctgacctttcgtgactctagttttttaatctgaaaaaatggtaatagtattgctgagaggctctgcaatggagattgagattaattaagatgatttatgttaagtgcatagcagagtgtttgcacttagtcagtttccaacaaatggtagcagtattacctttacatgtactaaatcatttcatcctgacctactatgaaaagcctgatcactttccatattttactgtttttaagataccattgattagagtatgcattgttattttatttttcaccaagaaaaatgtgctgccgttttagactatgacacgctatcatttataaaacgtgtcccaatttcagagcagctaacctgttgaaataaaatgtgagtcttataattgattattgtaaaacacaacagtaagtcttctttgattaggtgcaactgaacaatactatgaccacattcagtagcaaaggcacttagaaggatataggaatatagcttagcaggaaggtagcatcgggtatctctctttagtaggatgagtatgcgtagcaatctctgaagcacccagggagccatccaagagctattcactttgcagcacctgtccactctctcatgacatctcaggtgcacaggaaggaaacaaatcgagatgctgggtcaaccctggcctagaagccttatgcatcccagaggccaatgccttgtaacatagtttccaaggtcctcaaaaaggacatgcttagttacaagaattgttgtacttggggacgccccacaattatggttttccattaggtatttatagttcatatgtagaacacctaaccaaggtgtaatttaccagtccccatcatttttttttttaatctgaagcaatgttgcctgctcacacatttgacattccaactttatcagttttctagggagaagggagctagaaagttgatcaaagtacaaattctcatacagatggacaaagggtgtttttaaccctttactcacagtaatatctgttagtttcatttattttatatttaaagatactgaaacctgaaacttagagcagttaaatgacttgccccaactcatgggctaataagcctagaacccagatgttcttatttctagactgattatttccaacaacactgtaatatcctaaagcaagagtcagcaaactatggtccaagggccacatttagtcctccacctattttcagaaataaagagttattggaacacagccacatttatttgttcatgtattagacctgactactttcatgccacattggcagaatttgagtttggcccacaaagtctaaaatatttactatatggtgttttatagaaaatgtttgctaacctctgctctaaagtataattacaaattggccaggtgcagtggctcacacctgtaatcccagcactttgagaggccgaaatgggtggatcacttgaggccaggagttcgagacgagcctggccaacatggcaaaaccccgtctgtactaaaaacacaaaaattagccaggcttggtggtgcatgcctgtaatctcagctactctggaggctgaggcacaagaaccgcttgagctggggaggcagaggttgcagtgagccgagatcatgccactgcactccagcctgggcgacagagcgagactgtgtcaaaatagtaaataaataaacaaataaattctaattataaattgtttaactctttctatgagtctatataaggagtttatagaaaagcatttgtttctaatgtttgattattaaaaatacccctgtattttttattttattttaattgacaaataataagtacatatatttatgaggtacaatgtgatgttttgatatatgtttacattgtggaataattatgcatacttgaaggattttagagccacagagcctgaacctaaccgtttctctacatcagtgttggccaacttttttctttaaaaggccaaatagaaaaatttcagtcagtttttgaggcttcatgggccatttggtctctgttggaaatagtcaattcatgctaggattggaacctagataaccagactcaagagcccatactcttcaccagtaaggacttaggaaggcagcaagacctgggagtaccagtttaaatgaatgttcttctaagcagtgtcctgtgctgctattaaaccagaccagagctttggcccttagttaagaactgtatgtataaagttttccaaaataatggcttcaggttttcacaaagtccttccatccaaacaatgcagattgtacccccttaagaatctgttcttaactgccatctgttctctgcattcttaaagtctaatcttaatacagcagccagaatgatctgtttaaaaataagtcagatcacatcactcctctgctgaaaactctcctatgcttcctaatctcactcaggataacagccaagatccttccaaagatgcaggacctatcctcctccatccccaactctatgactatcattcctactactctccccttgctcactagattccactcaccctggtgtccttttttttttaattgaacatacacatacactcctgccccagggcctttgcacttgctgtctctgcacagattgttctttcctgagatagctacttgaatcgttccctcacttccttcagatctttatttaaataccacctactcagtgaggctttccctgcaggcactttctaaactctccacatgccacctccctttgccccatacctaagtctcttattcctatccagtgctttacattttgttctttagcacttttcactctccaaagcaccttaatttctcttttactacacattatcaccattagaatgtaagttttatgaggacacaaaaagtttgtctgttttattcgctgttacatatctagtacctcaaacaatgtttagcagacaataagtaatctgtcaatatttatggaatgactcaagtgattttttggaagagttttggtaatatttcatttgccaaaagaattctgccaaaaagactttgaaacccccactttaaggtggagagcttccatagaggcttctggatgttacttgatggtcacacctatgcccactctttcactggccttgaacatttcaagtatgcagcttagtagattatatcttcacagtttcacaacactttccagtttaaaaatcaatgctgcattatgctttgtatatttggacagattatttttgaaatccataaatctctaagttttttttttttaagtctccctttggtgagctgcccttgattagttcaaaatgggaagagagaacctgtcattctttgtcaatcaggttggcacgtacttgacagcatgcagttatagtgaaagagagctgtgttgcagtggtctagcaaacctaattgtagttaagtaaaagaacagtcacccaacatgagaggaaagacaaagaaactcaactgaacaatgttgtgtttttccatccatcagccttcatttgtcagagtctgactgacaatctggactgcagaaatcaggctctaacacaatattgattccatttcatattttgtttcttgctacactttttagcaaacagtttctgtatggaatgagagatagtgcagtcaatatatgcgaccagggcacatttatattaaaggcttactttggtttttttgtcccagaaatcacatattgtttgtttgttttactataatattgtaattgtcagctcttgctgcagtaacaaacaatgacaaaattccagtgacatataacaacaaacatttattactcactcatgtgtctgcagatcagctgcagctttactccacactatgaatcaagttaaggtcttttcattctagaatatggatctgctctaaatgtcttctcatcccaggaccctagcggaaagagcagcttttatatggcatattattctctcatgatggaagataagaacaaggggaaccagcaaatcttgaactgcctttaaagttccagctaagagctgccacacagtcccttctgtctgtccatggtctattggtcaaaggtacacagtcaagcccaaagtcaatgggaagggaagtatattcactgcagggcagccatattaagagaggaaatgaataataatgaactgacaaatcaaccatagtatccacaaatgtcttaggatttcattgattcccaaatgcattttttagtatttcaacacctctgaacttgagatatatcgtacaatagataatgtttacaaagtgtaggtttttttgttttttggctttcttagtttacataacaatagtggcccttatcatcaatgatagattagatagaaaaactgttaattgtggggttgacaaaatagccaaatggtagaaggcactccttataagtaagtaagttatgagtgggagctaagtgatgagaacacatggacacatacaggggaacaacacacaatggggcctatcagagggtggaggttgggcggagggagagaaccagaaaaaataactaatgggtactaggcttaatatctgggtgacaacataatctgtacaacaggccctcatgacacaagtttacctatgtaacaaacttgcacgtgtacttaaaataaaagttaaaaaaaattaagtgaatggacacttaatgtttacaaaaaagttgtcatttttatcttgaatttcttttttctgtagcaatatttatatctcattcagatcagcttatttgattagaaaaccaagcattaatagtagatcttatgtctatttattcacatattcatataccttcatttataaatatatattcatatatatttagaagatcaattggaaaacataagtgccattcccttatttaaaactcttgtagcttctccactacagttctgagggtggtatacaagatccttcttttctctggcttttgctttctatttctactccattacttcccattcccctacgtgatagctccgtacttcttctgcttcctgtctttgcatgttccatgttccctcttggaatacattctctctgccgtccatccccttataatgaggtgcatgagctgtttctgctcccagcctttctgtcctgaccttcttgtctatcaaacacaaaagtgatcagttcctgctctgtgctccattatacattgcactttactagttgttatacctgacctgctctaaatgtagtatatatttgtgtgtctgcactccccattcctaccccagtgaaacatagtaagcactgaataaatgtttgtcgaatgagcaaataaataaataaataaataaataaatgtttgaacatacatggaaaggttgtttatgtcctccttataatgtgctttgagatatatattcttaatatatatataatcatatattctaaggttattagtaggtaaaatgaaaatttaaagaaattgagtacaagaaaggaaaacaaggaagaattttttcctttttgtactatttctaagaacaccaaatttctagttaaacacacgcacacacaatcggcatgatgtagaattagaaatatgttgaataaatcaattattagaaaatgtaaatatatattaatttgcctctgacttgctacttttaccctcaagggttttttttttctacctcttttcatcactaatctttgcttcactgcttgtcagatcagcaactgcccattattagtaatgccatttaataagagataaataaaagtaaaggtgcttagagttactccatttcaaaaacctatcagggctggatttcagaagagaccatgaaattctcctactgttattgaaccattactccctattacctaattaatacaagttattttcttaaaattatacctgacattgtagtgaactatcaatactatgaagaaaatcaaactctcctcgtatcataaggatcttaacacctggtacacaatcttgcattggaggggacattaagaataaggcatggaggaaaaaaaaaccttaatggaaatgttctgttattagaaatgagactttttggtggaaatcccatgacgactttcttgtctgaatgttctttgaagttgaacactttctccttacacaagccggccactataattagctatgtttccattttagtggtggccttcttcaccttatctgaaatcatataaagatgtgaggccatttgcgagataaaaggtttgctcaaaccagttctctgacctggatatcagaggtttggcaatcataaacccactaagagaaaccctcagagctattacaaggctatgtaaaactttatttcattttttgtgagaagggacaggattttctctcatttatattctggaagaatattgtagaatgtatttgagttcaagaggaggagaaataattaacataatattaagaaacgtcaattttggaaagaaataataagcatatatgcacatgtgcgtgtatgcacacacacacacagtatacacaacagattcagaaagaaggaaatagagatttggtgacacatacttcctggatataatctcaactctgccatttgcaagccacatggtcttggataattgacctaatctctctcaattgcagcatctgtgaaattagataaaactttctttgtaggagtgtatgtgtgtatgaaaagcacagtgtttgacatataataaatgttttagcaactgtagcttgttaatattatcacagcagttaatatcactatagcagttagttgccattttcagcacagctaataattttagtagcattttctgatctttccatctcatgtggtttctttggagttgtttcttgctttgttttttagcttttctatgtcacattttatttgcatggagaaataacaaattttacaatttatttcacatattctttaatttttaggataattgtcagtttcttacagtttattttccttatactcactgaagaaaatatgtacgaaagaatattttcagtgaagttaattggatttactacagttgacccttcaagcaatagtatcttgcccttaataactgacctatctttgaactaataaattcaacctgcaaataaatgtagtgaggtaaattgtagaaatttatcttcaaaatggtctttctaaagtgatctatcaaaggtgcatttaattagaggtccagttctccaaaaatgtgccaaggaaaagtagccacaaagaatttagagctgaaatgaattctttcacccattgctctgtttctatagaactgagaataaatctcatatgggtacttaaaatctgtactatgtcattgaaggatgaaaagatgacaatagtgatgatagaaggacacggtaataggaaacatttcaatagagggaaatgatgtgagtatgcaatgttcattcaccagaggactaaatctagggctattttggtgacttgaacagggaatattctacttcctgcaagtgaaaaatatggacatttcatttggcatgccacctgctcttcagtccatcatgtagcaagcacccacttagtactttggagctctaagtaatacttggactactcaaatgccagccttgttgccatttctgtttattcgccaataacaattttattaattaaaatttgtatgtggatgtcttaaggaaattccttgtagttgtcaaagcagactcctgatcctatctatctgccagtgccttctgagtagtggtatctattcttcatgatttttggaactatttatgggtgattgaagaatatggagtggatagagaaggatgctagtcatttggctgcacacaagaaacacagatgaaatttttgactatttctgttcattttctaaaggtacagaattttcactggattgtacttgtaagcaattttaaaggaagaaatatccagccttttgaatttgttacagtgttgcaagacttttttaaaatgttaagaatttttatcatataggatgaattaatactctcataattttaggtttgtttcttccataattaataactatccttaaagattgtgtgtgtgtgtgtgtgtgtgtgtgtgtgtgtgtgtatttcttgattttccagagcaaacgttcccattcatttgttttactcaccttgttatagttgctcccattgtaagatatatctagtaagtttactgttgttacctaaatctgtttgctgaattttaaaaatgggaacatgtagtaaatttgggggaccacgagctagtatttacaaagtaaaccgagaacattggatataaaaccttatttcatttaacctccaatgaaggatatattcagtattattatttgtattatttcttgagcttccttgcttatctgtaatatgtaacatggtggcaccccttttcatataattctctcctcacttctattttgggtttttacatgttcttgtttcagtctcttctgctctttctatcttttcttggttcaactttcttctcttatcctgtggaggcgaatacctaattctggctctatcctcttcagtcactctacaagtatcactgggacaatattgtccaactactatttttacctccaaacctgtattcttagccttacccctaatctgcacactacgcttctttttgcaattactttctgtacatttgcatcagtgttaatcacaggcatcttgactcatgtctccaacctgaaaacattattccttccatatagggacaggctcctctgtcttccctgtacccctagacagtttctcccaagttataaaatcttggtgattctgaaaattttctttttccccatcaagtcctgccagtcctttatccacaacataggaataatacttcctgaacatccgtgctgctcctgtttgttcaataagtactcggacctctaaaggcatttcctatgtttcttccaccagccccttatccttaaaatcttgcctccaatctgccgctagagttatcatcttaaaagagtcaaatcagggttggtatccaagaaatattacaaagtactaagctcttggtatatacaatcaacttgagagaaagagagggacgggaggagagggagagagagagagagagagagagagagagagagagagagagagagagagactttattctgtcctctataacacctgaatgattctgtacatatttatgttaacagagcattgtactacttcaaatccttatacaagcaaaactcctcaccgccttttggcaatggaacttgcttttccctctgcctgaaatagtcttcagtatgttgacatgactcatttcttcacttcattccatttcctgaagagaggagcagtcttctgtgctcacattgcctaaaatagagcccactgtcactctctacttactctttttaatctttcttcatagcatacatatacatatatatacacacatatacatatatatacacacatatacatatatatatatatatgtatacacatatacaggcatacctctgagacactgaaggttcagttccagaccaccataataaagtgagtcacatgaactttttggtttcctggtacatatagaagtcaggtgtacactacactgtaatctattaagtatacaatagtgtatgcctaaaaactaatgtacatgccttaatttaaaaatatgttattgcagtgttcaagctgagagccaaatcaagaatgcaaactatttacaataaccacaaaaaataaaatatctaggaatacatctaaccaaagaagtgaaagatctctacagggctaactacaaaacactgctgaaagaaaccatagataacacaaacaaatggagaaacattccatgttaatggaaaggaagaatcaatatcattaaaatggacatactgcttaaagcaatctacagattcaatgctattcctatcaaactagcaatgtcatttttcacagaattataaaaaactatcctaaaattcatatgaatctaaaaaacagtctgaagagtaaaaacaatgctaagtgaaaagaataaagcatgatattaaccaacttcaaactatactataaggctacagttacccaaagagaatgggacttctacaaaaacagaaacttggaccagtagaacagaatagagaactcagaaataaagccgcatacctacagccatctgatctttaacaaagtaaacaaaaaaaaaaaaaatggggaaaggactccctactcaataaacggtgctgggatagctggctaaccgtatccagaggaatgaaactggactcctacctttcactatatacaaaaattaactcaagatggattaaagatttaaaaaaataaaatctcagccaggtgcggtggctcacgcctgtaatcccagcactttgggaggctgaagcaggtggatcacgaggtcaggagattgacaccatcctggccaacatggtgaaaccccgtctctactaaaaatacaaaaaaattagctgggcatgctggcgcatccctgtaatcccagctacttgggaggctgaggcaggagaaccgcttgagccagggagtcggaggttgcagtgagcccagattgcactgcgccactgcacttcagcctgacaacagagcgagactccgtccctaaataaatacaatacaatacaataaaatctcaaactagaagaatcgcagaagaaaacctaggaaatactattctggacatcagccttcagaaagaattcatgactaagtccttaaaagcaaatgtaacaaaaccaaaaattaacaagtgggatctaattaaactaaagagcttctacacagcaaaagaaactatcaacagagtaaacagacaacccacaagatgagagaaaatatacacaaactatccatcagacaaagatctaatatccataatctatagggaacttaacaagcaaaacgcagataaccccatgtaaaaagtgggcaaaagacatgaatatatagatacttctcaaaagaagacaaacgggtggctaacagatatgaaaaaatgctccacatcactcatcattagagaaatgcaaatcaaaaccacaatgagataccatctcacaccagtcagaatgcctattatcaaaaactcaaaacacaatagatgttggtgaggctgcagagaaaagggaacattatacgctgttggtgggagtgtacattagttcacccactgtggaaagcagtttggggatttctcaacttaaaatgcactgtcattcaacccagcaatcccattactgagtatatatccaaaagtaaataaatcattctaccaaaaagacacatgcacttgtatgttcactgcagcactattcacaatagaaaagccaaggaatcaacctagatgaccatcaatggtggactggatgaagaaaatgtggtacacatacaatatgaaatactacacaaccattaaaaagaatgaaattatgtcctttgtagcaacatgcatgcaactggaggccattatcgtaaatgaattagtaggaacagaaaaccaaataccactttgttctcacttataagtgggcctaaacattgggcactcatggacataaagatggcaacagtacatactggaaactagtaggggaagagataaggaaggggcaagagttgaaaaactaactattagatacggtgcgcactatctcagtgacaggatccatcatactccaaacctcagtatcacccaataaatatataaatgtaacaaacctgcacatgtaccccttaaatctaaaacaatagttgaaattatttaaaaaaatactttgttgctaaagcttgctagcagtcatctgagccttcaatgagtcttaatctttttgctgatggagggtcttgccttgacggagatagctgctgaccgatcagagtagtaactgttgaaaggttggagtgactatgccaatttcttagaataaaacaaccatgaggtttgctatgttggttgatttttttcacaaaagatttttatgtagtgtgtgatgttatttgataacattttacccacagtagatctttcaaaaatgaggtcaaggctctcataccctgctgctgctttaccaactaagtttacagaatattctaaaccctttgttgtcatttcaacattgtttacagcgtcttcaccaggagtagattctgtctcatgaaaacactttgttttgctcatctataagtagcaactcttcatccattgaagtttcattatgagatgacggccattcagttacaccttcaggctccactttattctagttctcttgcaattttctccacatccagtgacttcccctactaaagtcttggaccctcataggcattcatgagggttggaataaacttcttccaaacaccttgtaatgttgatatttacctctttctatgaatcacaaattttcttaatggcatctggaatggtgagtcctttccagaagattttcagtttacccagatccatcagaggaatcgctacctagggcagctatagccttacaaaatgtactttttaaagaataagacttgagagctgaaatgactcctttgtccaaggactgcagaatggatgttgtgttagcaggcataaaaacaaaatctcttggtacatcttcatcagacctcttggctgaccaggtgcattatcaacaagcagtaatatattgaaagagattttttcttctgtgcaataggtatggccagtgggcctaaaatattcagtaagtaaaccatgctgtaaagagatgtgctatcatccaggctttgttgttccctttatagagcataggcagagtctattagcataatcttaagggccctaggatttttggaatagtaaatgagcattgtcttcaattgaaagtcatcaattgcattagcccctcaaaagagagtcagcctgtcctttgaactttcgaagccaggcattgacttctctctagctatgaaagtcctagatggcatctttttccaatagaagactgcttcatctacactgaaaatctgttgtttagtgtagctaccttcatcatcttagatattagcttgatcttctggatagtttgctgcagcttctccatcagcacttgttgctccacctttcacttttatgttacggagagggcttcgtcctaaagcctcatgaacaaacctctgctggcttccaacttttcttctacaatttcctcacctctctcagcattcatacaactgaacagaattgggccttgctctggattaggctttggcttaggagaatgttgtggctgttttgatcttctgtccagaccactaagacattctccatattaacaataaggctgttctgctttgttatcatttgcatgttcactagactggcacttttaattttcttcaagaatttttcctttgcattcacaacttagctaacgggcacaagaggcctagcttccagcctctcttggctttcgacatgccttcctaaccaagcttaatcatttctagcttttgatttaaagtgagagacatgcaactcttgttttcccttgaacatttagaggccatagtacggttattaactggcataatttcaatattgttgtgtctcagaatagggaggcccaaggagaggaagagaggtagggggatgactggtcagtggagcgttcagaatacatacattaatggattaagtttgccatcctatatgggcactgtttgtggcaccctgaaactattaaaatagtaacatcaaagattactgattacccatcaccataacagttataaaaatattgaaaaagcttgaaatattgtgagaattatcaaattgtgacacagagacatgaagtaagcacatggtgttggaaatgttgctgatagacttgcttgatgcagggttgctacaaaccttcagtttgtaaaaaaaaaaaaaaaaaaaaagcagtatctgcagagccaataaggcaaaactcagtaaaatgaggtatacctgtacatatacatacatgtgtctatatatccactcacacatatgtgtatgtgtattatatgtgcatattatacatatatgttgatatgtgtatttatcatatctaatacacatatatgtatatacatgtatatcacacacatatattcatattgtaaattgaaaattttctagtgctgtatcccaatctctagcttataaatatattgaatagatgatgcagcaggtatcttttgaatacgcactccaattttagaaatataaatcttttttaaaggttggaataatataagtagtttggtgttcagtgcaaaaggttttaatgtataaatactatgaaaacaaaagttagatcaaatgtatcaaatacaaatgatctgtattgggggacagagggacacattaaatttaagggaatatgaggagaatattgacttcctatgctcgatgagtgaaaaagaaaagtgaagtgggagtgtttgaaaggaaagatgagcttttccatgctagtacatcacaggttttaatactcatagaagtttttagatttgtataggaaatatgatcctccagcctttccaagtttactcttctactggaattacaaatcaaaactaataaatgtttactatgcttcaagtgcaatagttataaagtacctgattagaggtcccacattcagatgttggttatataaaatattcatgctaaatcatataaatgctaaaacatttgtatttgtgatgttctcttggattgctagatggagattaaattatacaaattcagctaagaagaaaaatgtgggataaatggaattttagtttaaaggaagtcaatgaaaggattaattaagtataaaataatcccattttaatttgtcatagaaatgagttttctgagacattgttgtaatcaataacgtgaagatgtaaaattttgcaaaaaaaatcattacgggaaatccaaaagcagaagagtagactctgtatttaactctagcagattatttagaaagaaaatagtctatgccatgaacctttcgactgtctgcgtgaacaaatgtctctagtaatacacactcttaactcaattcccataggctcaaagttgcaacagtatttatttgcccgttcaacggttttttgtttagcacttactatgtgttaggcacttccagggatatgagtgaacaaggtagttatgggtcttactctcatagaggataattctttaggaatggtcaaaactatacatatacacataatgtgattaattgtgatgtgttttgaaggaggaagcaaaggagttggaacagtttaaataagactgtaggttggcagtgggaacaatggtctttgctatcatttttcaaaaattccaatgaatgggaatgacgactgttgcattaagttgcctgtctccctctgacccatagtgattctctattatcagagaggtagggcatgtttttcagcatatgtgataatatcaaacagattcagatggtgaaagtaaaatttcttaatgcttagaaataacataatttgatcaaatcatttggatatgttattaagttgttgtaagatatgaagacgtagctgttactactgccaatagtataaactttggattcagacctagctgtgtttgaatattaactctcccacatcccacgaggttgtgggcaagctattcacatcattgtcactaccgtcactactatcccacccacccttgcttcattttcttatctgtaaagtggcaatctgttggaatcagggttggggaaggcaaatagtagtcattatacgaatggtaactatgctatcatcaataatatagtctacagctatgatgaagctaatcagaaaacattgtctattaccagtaattagctatatcaataactatcacaagaaaagtcccagctgtcagtgaataaatagaaaatagtgctttgtcttagagaaacacatacaaaatgaatggtggtgacagtgctttaagttaacttgtcagtttatatgtgtaatgcatatataatttcaaatgtataatttagacattgtacatgtatatttggcctggtaatttatggtatacataaatgataaatgtataggttgaaaattcagttactttttttccttttcttaaatcatttttaccttgctgaagatatgctcttttctctacttccttagaataatatattttattttctcttaaagtattttgagaccatatcaccatttactacaccaaaatgtttttttgcaaatgcggtattcaagggtgaatttatagtggctggggacctatttggaattcagtaagtaaaactagattttccttattcctcatctgagatcagagctatttctacctctagcaaagacatacagtcattccgggtgctgcattttcagggaacaatgtgttttcttggcaaggggcagtaagaccatcaattaatagttcttcatgtaaagtagctaaactactgttataaaggaagtgaaatttgcatacataaccattaacacatgaggttagttatgtacaattttgaccaaagtgcctgtttgctgctggtatttattataataagaactggaaaaaaatagtctatctcaagagcatgtgctgagcacccgtaaattgcaagagactgtactgggcagtatgagattatagtaatttgggatttcctactaatgaactgagagggaacaggtacaaacacagtatacgaaggaaacagtggcacggagacacttaaacacagcagtgctgggaggctccggggtaggggagggaggaagagagatacgggttaatcaggagctgctctctggggaagattgcccaggccctgactgatgcctgacattgattaattgatactctatcctagtgtttaacaagtgttccatccaaaaagtcttctgtaatatttaacttcacttccttcagcttcaatttctgcacaattcttttgtcgtctcatcaagagagctagtcagcagacagtaacaaaatgcttatattcatatacctgaaggatttttttttgtcatgcttcagccttctccagactgaagaaaagcaaataataaacaaaattaatcgttcttcagaaggcctgtttgactcattaataaataataagctttgatactgtgctttaagtgtttaccctttggaaagaaaataattttgacagtgatgtagaaataattatttgatatttatttcaaaacaaaatttatatccaatactaaacacagaattttgtaaaacaataagtgtataaagtaaaatgaacattaggattattgagattattgtagctaaaactagtgtttattcatataaattatgttaataaattgtattgtcattattgcattttacttttttgaaaagtagttaatgcctgtgtttctatatgagtattatataattcaagaagatattggatgaattttttttaagtttaatgtgtttcacatctctgtttcttttctctgcaccaaaagctacatttttgtgcccttatgtaccaggcagaaattgatctgcaatacatgtggagtctccaagggtatatttaaatttagtaattttattgctaactgtgaagttaatctgcactatatgggttcttttccccaggaaactgaaatagcagttcaagctaaacaaccggatgtggaagagattttgtctaaagggcagcatttgtacaaggaaaaaccagccactcagccagtgaaggtaatgaagcaacctctagcaatatccattacctcataatgggttatgcttcccctgttgtacatttgccattgacgtggactatttataatcagtgaaataacttgtaaggaaatactggccatactgtaatagcagaggcaaagctgtctttttgatcagcatatcctatttatatattgtgatcttaaggctattaacgagtcattgctttaaaggactcatttctgtcctggtgtgctgccatcaatacaaaagtagtcccaccttcaaggtagattaaattctttggggctttattgctttgcttgccagccttgatgcttttcatattgtttggtttaattcaaatcaagctactgcatcatagtgtctgtctccaacagctgtaaagaatcacaatatggtccgtgacctttcttttctttgttgctctttcttataaaagagtaaaatcggcattgaggcttcagtattttattgggtcaagaatttttagtgaaatgtcatgtaattgcttatttctttggcaaaaagctggcctgggataaacctttctacttttttttcttctccatatccatgttgaagtctaggtcacatttattcacaggctattacataaggagggagatggaaagccaggtcagttttcaaaaaatagctaatcaatggcttccatttgcaaatgagagtccagtgctaaatatacgttagcagtaggttacctgattctctgtacctgaccagaattataatggctcccattatgatgaaggttcctgagatcctgtaatcatggctgtttattgatcagtcttggtttctcagttaatgttgcaggcttggatacaatgaacctcgtcctcatgtttaaaactgcttgaaaacagttcaggtcaataacctcattatacagaaccagtttgtccttgcaaacaacattaccatgacttagattctgtctctaaggtcgctgcttagtttcccttgcgcttggcccaagcttcatttctagaagattgtttgttttccttacagcttacaagagacttttccttaggtagagttgaagtttgcacctgagcttaatgtccaaacaccagacactgaaaatcacaggtttctctgtagatatcaacatacttttattcagaaatatattgcaaccactccaaaaatctagaaaagtagtttgtatccagttcaagcccagtataatcatttttcataagctaacaatgtgctcagtatttagttggaagagctaggcaaagtcctgaaagcagcaaatttcagagtttccgttgatgttctgaagaaagccagccctcagagcagttaatatggtgactttcattgtagcaagccatgcagtgcacaaatggacaattgcatacgtttctatctactctttgttgatcctcaaagactttatgccttatggtgtatgactatgaattaaggtttgtcactaattgttagagatcacaaaggtacatgtaatttggcttttacttttgtgcctttgtaaaagagagagagagagatcttaattaaaagccactgagaaaatttttgctttcattatgtataaaacaatccaaatgcttgatgctaacttatcgcacctccacccacacactcaactactgggccacttggagatcagaactgggatctgccatgcctgagcatatctgcttcctgctgatgcattagtgatgtaaaaggagaattacttttctgaaataaaaagaaagaaccaggagctgttgctttccttctctttcacaacccttaaaaccatttttgtagcagacagcactgtttttttccttcctttttttttttctccttccctgtttccctattttctctcaatttgacacattgggagaagctgaacttaagggaaaatttattcctgtcttcccatttctcccttggatttggagaaaaatcaacatatcaagttggctgggcatggtggctcatgcctataatcccagcactttgcgaggccgaggcaggcggatcacctgaggtcaggagttcgagacctgcctggccaacatggtgaaaccctgtctctactaaaaatatgaaaatgagccagctgtggtggcaggcgcctgtaatcccagctacttgggaggctgaggcaggagaatcacttgaacccgagaggcagaagttgcagtgagccgagatcgcgctgttgcactccagcctgggcgacacgagcgaaactccgtctcaaaatatatatatatcaagttgataggggcaaaaatgcaagaatgatttgagaattatggggtttaaaaaaatagttgactcacgcacaacttttgctgtggaccatgaccttggaaacatctgaagattagctggggtttgcggtagcctgaaacacctagaggctcaaaaaatgacctcacagttttgaacatgacacccagcaatacaaggcagaaagctgtgagggctgtttaaatctctgcatggatcaaaaatttatttttaaaggttagagatgatttttctgaaggacactccattgctctgatagaacgtgaacaaagcctttttaaactttgagtccatatatcaaaatttaaaatttgtcctatttataatgcctcttcttcactctgggtcttgttacctcttaatagaagaggaaatgagtctgagtagcctgcagcacattttcatgagagaattgtgtttctgtttttgttttttgggggaggtgcatttggaaactgtaataattatgaagaaaatgatattctttaaaaagaaaatgaaaatctctcacgatgtatatgcaagatctagtatttaaatgcataattagtgtgtccaccgcttacaaacattctaattaaagacacatcagggagcaattctgtttcttaggaaattgacttgtctattggcacctccgcattctgcatcagacagcctgtctgtccagctcctacgctcacctcccaagctgagttctgattggaagctgggttcatccctgctcagtttctttcctctttcttctttccttcacttcgtcaacttctttaagatttcttttattttcaaagatggtatatttctggtttcttttttaaaatctctgactaaccaacttctttattttctttgaggacttcctgtaaaaggtcaaatacatattatgaaatgataatactaatgacgtataggtagtactaatctctgctgcaaaataactggaaaaatcttaggatcgtatgatcaaatacctctccatctttgtttagcacttcaactctctttctctctctctgtctctctctctctctctctctctttccctccctccctctccactctctccctctctccctctctccctctctccctctctccctctctccctctctctctctctctctcccccttcctcccccatctacacacatacttttatttatttgtatgttatttcttcatcttaacttcagaaattactgaagactgactatatgagttatataaattgtttaaaattttgctaaagttatagttttggtataatatattacattaatgccatagatgaaatagtctttaatgtgttccatttttccacacagtaataactaggtcctcaatagcaccccatttagcagtttaaaagcagcaaaaacaactgctatcagtaacaacaatataaactacaaaagaagccatttgttatttgatttttattataaaattgtatttttaactgtcttgagcttaagcatttaggtgccattttcttgtattcatactcatttttaacttaagttggaaaactacactttcagttaacttttaaaaatatgtttatgtactttcaatgcttacatcacctgccatgtattagaactgagagcattaatggaattttaaatgtcttggttactttctaaagtgataaaatgaagccagctggtttgctttgctaactttttatattatcaaaaaatgttacttacacaaacctagtaatatgttttacttactgctcttgaattatttttcaatgtaacagaaaaaggtgtgaggaactttctgtatttggccaaagcgttccatcccaacctttaacacaaaataattgctgtagacaaatggtcaagagggcaattataatcttccaggcatcatttcctcagatatgaactgcaaaatgacagcatcattagtcattttcaattacagtcagtcacaaccagggatgattcattttcccagctgttttgttgttaattaactagatgaagctgtttttttttctcccaatgagtttgttctactgccaacatcaacatcttaacatttttaaaaacttccttagggtttattttttgcctaacaatctttaatatattactcacaaaagatgtgcatctcaagatttatccacggtatagcaggtcaaatggtatttcattggtcgaaatgttgccgaaataaatataattacacttaaaacaatacttggatttcataaatcatctgccatgcgtacaatctcatttacctggtgtaacttcacttgtagcaacagaaatcaatagagagataacagacaaaaattgtcccctgaaatgaacaagtctattttgactgactcatttattgagcacaatttccatgccaataacaccagaataagttgggagaggacttctagaaagaagataacaatattagaggcatttaataatttataagtaaatgcatagcaacattttatttttttaaattacaagtttgcgactgggcgcggtggctcgcgcctgtaataccagcactttgggaggccaaggtgggcggatcacaaagtcaggagatcgagaccatcctggctaacatggtgaaaccccatctctactaaaaatacaaaaacaaaattagccgggcttggtggcaggcatctgtagtcccagctactcgggaggctgaggcaggagaatggcatgaacccgggaggcagagcttgcagtgagctgagatcacgccactgcactccagcctgggtgacagagtgagactccatctcataaataaataaataaatacaagtttgctttacaactgaaaaaaaagtcttggagtataagaggttgaataaatgctaatcccaatgcataaacttgaggagagcttcactttcccaatgagaagagaaaaaatttataatagatttttgggcaacttgtaaacataaacatttagaaatatggatgagattgtcaaatgtctaattatattcaatttcttaattgagtagcatttccatatttgcagtcttacattttataaaataacacactcatttagaaatacctggcacatttatattttatgaaacaatttcattcaaacccttcgtatgtatattctagaattgtagagctcatcaccttgctaagttatttgtaatatggcattgtttgaatccctacataatactctgaaagccctctggccaagattacaagcaacatatctgtaatcaaaaaattaagaatatttaccttattgcagcaagagcgtaaaacacttcagagtgtgggcatctcagtaagagggcattggaaaaagcttcttacagagttcagctggctgcatgattctaaggaggaattcagaaagtagaagccatttctggattagatgctttcaagaaacagagtcaatgtagtgattaggtatcttagtgtttatctagaagatgagattaaagtagggctagacacgtcgttggtaaaggagcagcaatgcctcatattagtcatttctgtgatagcagaaaggccttgtctctgtcttgtttcaaacacggccatggggtggccttgtgtctgcctagtttatttctatgagtgttttttaacatccagctgggaccatcatggcctagctagctgccagctgccagctatcagcagagctatttttcacgttctcaatgctgtcgctgaaatttttatcccaaacttcaatacccattcacaaaatattaggaaaactgtttttttcatttttcttagatatgattttggttgtttgtttgtttttgagacggagtttcgctcttgttgcccaggctggagtgcggtggcgcgatctcggctcaccgcaacctacacctcccaggttcaagcgattctcctgcctcagccttccaagtagctgggattacaggcgcccaccaccatgcccagctaattttgtatttttagtagagatggggtttctccacgttggtcaagctggtctcgaactcccgacctcaggtgatcaggctgcctcggcctcccaaagtcctgggattacaggcgtgagccactgcacccagccagatgtgatcttttaaaaattcccaatagactaacatattctttctgctttttaagttgtttggctttttaacaaattctttgaaagactcgtttacaatgatctctgccacgagtgattgtgaagctatacattaggaatgattgctaaagatttatcaactttctttgcctccctttttaattaagcaaattctgtcagaatacttatgtaagcatcacatctcttgaggttatttcaggctaatatacaacattgtggttccgaataaaataattgagacataagagatagtataaagtcttgaatatgagccaactttcttttctgagagaatatttgagtgaaaagtctcatgtactcagtagctcatgctgaaattagggaagcattttagagatttgaatttcacctcttgtcctcagttgtattagttacacttaaagagagagacaaagagacatagatgtttcagttacaatattcgaatgtatgcctgtatatatacagccgtaggtagagtcctttatttattcagtagatattaattgcatgccaaccattgacacaagatatatttttaaattttgaaaatctcaaactcaaatagagtttaaaactatattctagtttacttttttaaacaaatgattttttatgattgtattaaacaaatacattatttttccttacttattctacatcaaataatatctatttctagaaggcttttttccttgtcttaatgatagaaaacataaaaatcatttaatattttttaaatatccaaaaaatatgaggcaagaaagcagccacaattgtagctaccttaggaaacttaattaaaaaatttttttttatttttaattttatatgtgtataattgtacatatttatttgtgcggtacaagttatattttgcttattttttataatttcagtagttttgggggtataggtggtttttggttacatggatgagttctatagtggcgaattctgaaattttttatgtatccatttcctgagtactatatactgtacccaataaatagtcttttatcccttacctcactcccaagctccccacttagagtccccaaagtccattgtatcactccgtatgtctttgtatcctcatagcttagctcccacttacgagtgagaacatatggtatttagttttccgttcctgagttactttacttggaatagtggctgccagctccattcaagttgctgcaaaagagattcttttttatggctgagtaatattccatggtatatagataccacattttctttatccattcattggtcgatggacacttgggttggttccatatcttgcaattgcaaattgtgctgctatttttgtgctgctgctttcttttttgttatttccttttctggttttggtattagggtgatactgacttcatagaatgatttagggaggattccctctttatcttttgaaatagtttcattataattggtaccaattcttctttgaatgtctggtagaattcagctgtgaatccatctggtcctggacttttttttggcaatttttaaattactgatattcaaccttgctgctcgttactggtatgttcagggtttctttcttttttttttttttttttgagatggagttttgctctttcacctaggctttagtgctgtggcatgatcttggctcactgcaacctccaccttccagtttcaagtaattctcctgcctcagcctcccaagtagctgagattacaggtgcccaccaccacgcccagctaatttttgtatttttagtagagtcggagtttcactgtgttggccaggcaggtctcgaactcctgacctagtgatccacctgcctcagcctcccaaagtgctaaaatcacagacgtgagccaccgcgcccagccaaagcgttcagggtttctatttcttcttgatttaaactaggagggttgtgtgtttccaggaatgtatccatttcctctagattttctagtttgtgtgcataaaggtgttcatagtagtagtgaatgatcttttgtatttttgtgatgtaggttgtagtgtttccagtttcatttctacttgagcttatttgaatcttctctcttctttccttggttaatcttgctaatggtctatcaattttgtttatcttttcaaagaactatttgtttcatttatattttgtatttttttgtttcaacttcatttagttctgctttgatctttgttatttcttttcttctgctggatttgagtttagtttgttcttgtttctctagttccttgaaatgtgacattaggttgtcaatttgtgctctttcagaatttttgatgtagtatttaacactatgaactttcctcttagcactgtttttgctgtatctcagaggttttgataaattgtgtcactattaatcatttcaaaaaatattttaatttccatctcaatttcattgttaaccccaaaatcattcaagagcagatttcttaatttccatgtgtttgtatagttttgagggttccttttggagttgatttttagttttattccactgtggtctgagaagatacttgatatgattttgattttcctaaatttattaagactttgtggtctcttgtatgacctgtcttggagaatggtccatctgctgataagaatgtatattctataattgttaggaagaatgttctgtaaatatctgttaagtccatttgttctagggtgtaatttaagtccattgtttctttgttaagtttttgtttcagtgacctgtctagtgctgtaaatggagtattgaagtcccccactattattgcattgctgtctatctcatttcttaggtctagtactattgttttataaagctaggagcaccagtgttaggtgcatataaattgagtactgtagtaaatatcttcttgttggactaatccttttatcattatacaatgtctttctttatcttttatttacggttattgctttaaagcccattttgtctgatataagaatagctactcctgcttgcttttggttcccatttgcatggagtatctttttccgtccttttaccacaagtgatattttgatacaagcatataatatataatgatcaaatcagagtgattgcagtatctatcaccttaaatatttatccattttaaattttaaaaggaaagctatattcagaaatcactttttcttgtaactaattcctgttcttcataaagcagaaatttcatagtttgatatagttgtcttaacatttaatgaatattttcaagcaaagtatatacaatggagaataatgctcagctgcaaaagtcacctataataaatctgatttttccatttacaaacaaaagaattcccaaagtttatccattttggtagaacacgaattcactctgttgagtttggagctcttgtgcggaaaaccttggacctgcaatttagttagcatattcaaagttttaaaattatggagatgtagtcaagaataggacttgataactattatcccactgatacgctatttaaataagttgggatttaagtacttatttgatttccttaaatttgcttatagatgattaacatgtattgcaaattgttaccttttacagatttctattgagcactgcttaaattttattatatgatgaacacctgactagttgctacagccaaacattttttgttatgcaaatgaattttacagcttaattggaatgatgagagaattgaaaatatgggcaaatgccagagaagtgaaaagcaaaatgaagcaaaacaaaaaagaacttgtataatatataaataatccatttcaactctacagtacaccaaactcttgaaaaagtagcaagattgtttttgtgaacagccaaatcaaaaactgtagtcatttcataagtatttgctaataattataaaagattggaaattatacagttctgagcttattgaacctttgacccattgcagtgtcctcagacatttgtgatacattggtagtgccatttaattttaaaaatccacctctacattagagattatagtaacccctcatttacctatctggaaataagagtgggaaagataatattagagtaaatggacagactatttagagtttatgtattaataaaagagaaattgcatgtacaaacatgttattttctaggtaactaaaacctagtcctttaataaagcactgaaaaaaattttatcgtaactattttaatgagaacttttcttgaatatcttctgttttgcttcattgagcagcgcataatatctaaccaacaaatttatagtgctttgtagttcacagcatttttaccatataaaatatctcgtttagtttctccaacaaagctatgagttaggtggtattattatatccatgtttcaaggatgataaatcttagtgacccatctcattttccaaggatcacacaaccagtagtagtgaattaggaacgaaacctaagacttctgattctaaatcacaatgtaaattaacttttcttaattttcaggggtgtcgttatcacatcaatttttgctctgtttagtgatacagtgttatatgaggaacatgaaattcaaagcaccctttcttcagttgagacccagttgaagtggttaatttgcttttagaagctagactgtaagataaatacatacctttaagtattaaagctaactcaaatcactgagatacttacaccatgagaagagagtggaacctaagtcaactggtagaaacatagaaacagcaaactttgatctctctttatcctcattctgaggggcaatatgcttactgagtggaaagatgggcatacccccagcagtatttaaatcaatccctaatctatcactatctctccttttctctctatctcagcacatataggtgatttcctataaattaaatggtgtaggatgagatttcatcccatgttgaaaggtcatttcattgataaatgactaagattaccacatttctcagttttaagtttttcatgttcattgtctcctattgctactttctgttatcagaatgattacttctcattgcttttagtattctgtctttgtagggttacagaaacttcacagggaaaccagaagatcaaatatattactcactagtctcttagaatatttaatttttagtgtttaggttctgatgtcaggacaggaaaatatcttccgtgagtgatgacttccaagggtggttttcctgactaatcagaggcattattttttgtttgcttttgggttcaagactgatttttaataaataaaaaagttacatttattgatatgctagtaaatatttacatcatgcattctggataaaaacattgaaagccttgatttgacttgatgtcagacacaatagacatagtctcaagagcactgatgatagttaaattaggaagtgatgaattcttactatatattatcttttgttcttagcacagtttattttatatttataaaatttaatttatattaatggttatgtttaataaccgattagcaaaattactgaaatgtgacaataatatctctattcctgtttctttcctgctttatccttttaaaatatattatttataagtatattttaaatttataaaagctacattgtgctataaatcttgtttcttagcttttctaacattcataattgtgttttaaagatccacccatggccgggcgcagtggctcatgcctgcaatcccagcacattgggaggccaagatgggcagatcatctgaggtcaggagttcaaggcagcctggccaacatggtgaaatacaaaatacaaaaattacccgggtgtggtggtgcgagcctgtaatcccagctaccgggaggctgaggcaggagaatcacttgaacccaggaggcaaaggttgcagtgagccaagatctcaccactgcattccagccagggcaacaacagtgaaactccatctaaaaaaaaaaaagaaaaaaatccatccacattgctctacatatacccttatccatttctttcacatacatacccatgttggcctcaattccccacaatgcagcaacaaactttcttgtacttccttatgaccttaagaatgtgagagaaacttctccggtatacactggtgagggaatatgatcagcagggttttttgtttgtttttctgtgttttgctttttaacttatgcccacctttctgttggcagtcagcagccacatctgaagttatagctctctgatttagacaaggcttattcttccctttgttacaacctagtccctatagggacctgaatttgtgaccctagtctatgagattactttttaaatacagtttggttcaggatttataaaagcctaataaggctgggtgtggtggctcacacctgtaattccagcgctttgggaggctgggatgggcagatcactggagtccaggagtttgagaccagcctgggcaacatggcaaaaccccgtctctacataaaaatgtatgtactcagtagtactactcagtagtagtactgagtagctactcaggaggctgaggtgggaggattgcctaggaagtcgaggctgcagtgagccgagatcttgccactgctctcccgcctgggtgacagagtgagaccctgtctcaaaagaaaaaataagcctaataaaatgattgcacgcctggaaaacctacataggctccttcaagtcccatatatatataaagtcatccatggtatgtagttcacattgaagtcaagttgggggaaaagaaacttatttatctctttctcttttcctttattcaagtagcaattttcatttaattttattcaattcagaaatatttactgaactcctcttattaggaagcactagactggatataaagaaaacatcgtacaaggcatagaggactcagtcctgccttgcgaagggcacatagtctgactggaaagacacatgctgacagggtagactgtgttaggaataatgctcaaaatcctgaggacattgaacactcgaacaaaggattcttagcaaagcaattttacttctgcacagaggggtgcctccttggccagttgccatgagagcacacctgaacaaaggggcatgagagcctttattcctgacgcaagtcctgcccctgtaccctttccccccattggctggggttgggtcgtacaatctaaactaatcccagttggctaaacatttgatttttttagatagggtgggcacgtaaaatcaagtggagaggaaggggaaggggcgtctgtaatgagctagaaagttagtcctctttccaaataaggaaatgaatgtgagctggtactgaggtgtgcctgggcatctaacaaaggtaaaaaggaaaaaggagaaaaatcagggggtactatgaattaaagaataaaagattgatcagattatttgaagagaaacctcatcatatcccacaactggaagaaacaatttgatggcaagtttctcttcgtcgtttaccagctcaaaatctcaactatcaaaggcaagaaaaatacacacacacacacacacacacacacacacacacacacacacacacacccctctgcctttttctgtatggccaaagccttcagtccagctgaccacttcccactccagttaccatgttagcctcccaacttgtatctctgcacccttctgataaagcctccacaatgcaaaacacgaatcgtatcatatggctcttcttctctaaacacttccatctactctgtggttttagaagagaatgtaatagtcccacattacaaggtcttaataaattgcattcttgcagctctgtatcattacttgtaaacactgtagtctagatagccaggacacactgcatttcttttttaaggctcgatacctcttgccattttgcacgtagttttccttctgtctgaaatgccctttttccacctggcgcttgaatggccccttctgaaaacttcctagtcgtctttcaaaataaattcaaatgttagcttttgtgggtaacctattgacctctccaggctgagttaagctgttcccccgaggtgtcttgttgaaatcattattttttcctaaaatctctgttctaatttacttacatgtctgtgaatgcttagaggttacgaacttcagttttgtaagcttagtaactggcacaaagtctggcacagagtagcacctgaacaattatttttctggaataaataaagtaatggtttcattgaaatgattcgcattaaattaatgattagcattaaactacaacgtgtatatgaaacattccagttaggttgggttcattccattcctatttaaagagtttgtagtttctggctcttttccaactctgattcttcagactagaaatgcaatttctgctaatgtatttattttaaccaaacccgacatcaatcaagttatttgtattcctcataaggtaagcataggaatttacagtgatacaaaaacgcagctattatctcttataggcactggtaaagcttttgtgactagtgctactatactggtaaggtattgctgcttgtaatgaactaaatatttcagtggcttaacacaataggagttcttttcttgctcacatgacaacccagcgtatgttttcctagtcaagcagctttcttacatatgttattgcagaaacctaggtcctgttcatcttcttcctctgcctgccattcccttggtagcttttctctgctcgggtttcgcaagaggatgaaatcctattgaaaatgatctgagggtctattatgttctcaagaatggtacatatctagtctatgataaatgctcaggtaactgattaggtgtaatagatatcttaggattttgtcatgaacaatcagcatcaacaccacctggaaaattgttaaaaatgcaaattattgggctccacccagtatctactaaatccagaactccggggctaccatgcagcaattagcaaggtctccaggtgattctgttgatcctaaagtatgagaacaactgccctagggcgttaggacttaattctctcctcagtaagttgtaaagatttgccgtaggacctaagagtcttctgcttccagcaatagaaaggaaaaaaaatgtggaaacctcactaaatttttcaaagcctcagccccaaactgacaaacaacacttctgctcacattctgctggctataaattatcgtatagctagctgcccagtgaagtggaaccagctcaggacggcctactgttatattgccaggcattttttgagccacttgatgttatcttcttggtaatttaaatttaaccgtggtaggaatatttacaccacagaaattggcaaacactaaaaacaaggtgtttttaaacaccctgagatcagagatccagttgatatacatctaccagcacaccactggccatatacaggcttgccttatgccacggggagctctgcagctgaagtagcccttcaaacttgtcctgctttgagccaaattaggcctctatactttcaccttcatcagtcactgaatgagggctgcctggggaaaggcatgaacttggacaaggcagctctctgcagctcaggcagtccctgaagggactgacagttgaagaatgtctactgacatcatttccatcatctagaacaagagtctttctttgaagggggctctgagtagcatattcccgtgtccactgcagcccctccctttaagagactctgatataattgactgggggtgagccagtacattaggattttcctaaagttatctggataattttagtatgcaaccacaatagatactcttcaagaattaagctagttgctgagagggaactgttttttgttggtttgttttcactaatgtttgcactctacttcctttaaataaaattatgcctggagaaagggtttttgtatggagcaattgataaatatttgtagggtggttggctaaaataattataattcctttaaaagaaattctacccactaaagttaatttagaagtaaaatataatagaaatccaataatatattcaccaaatggattaagatgttcatgaattatcttcaaagtgttaatcgaataagtaatgtgtatgcttttctgttaaagaggaagttagaagatctgagctctgagtggaaggcggtaaaccgtttacttcaagagctgagggcaaagcagcctgacctagctcctggactgaccactattggagcctgtaagtatactggatcccattctctttggctctagctatttgttcaaaagtgcaactatgaagtgatgactgggtgagagagaaaatttgtttcaattctaaagatagagataaacctttgtgttattgactgtgcaaaaagtcttagagtacattccttggaaattgactctgattcaaagtgttgcatgacaacgggatatggggagtgttctctggagatacacccacaaggaagagaagagcacaagggagattgtgggagagtctgaaatgtgatttgtctgcagcagaggcctaagccagtctcgcaggagccctacatctgggctggctgtgcagagctgtcctgaattgcaggcagtgggcctggcccttgtattcctgatccagccagccattggccaggggctggctgctgcctgagagtggaaggacaacttggacaagttttctgaggccgaaggcaattcttagtaaggaacaccattaacaaccaatattcctagcatccagggatgtgtgcattgttcctgaagagggacaagtatgtctacaaaaatcacagaaaccacagaaacacacacagtcctactagcacctctccctgtcccatttgcaaacaatttaagagctctcccatttttagttcaagaaaaagaaaaatggattgggaggaccacaagctgacttgggggaggaatatttcctcatttagctgtagttttaacttttgttttcactgcatattttcagtctattttattttctttcctcttcagttgttgatagaaggtattcataaattctcatggcaatgttaatgctggctttgactctcaggggaaagaggccagaaaacttctttgctgtaccattccataattaggcagaactaaaaacatctttgggtgttgttttttgtttttgtttttttttttgccttgtctgcttttcaaagatcaaatgattgaagcattaaagcatggtgactggttcttcaggtaaagttgatttttattttatgtcaagtagaaaaatactgaactggaagaatcacagctggggtagcacaatcataattcattagaaggcataaatagtgcttggattaaaagaagccctacaatctggggacagtgcatctcatgtgccctctgggattactcggcagtcatcagagttagatttaacgactttggagacttaagcattatggttttttttttttgtcaatctgggacactgaaattgctgtatcagggttatactcaactgtgtcaggtttatttgtttttatgagctgtaatttttggttccctcagcgcatatgcatagtttgttcctatgttatcatttattggtgtctgttttctggctgtctctggtaggttcagcctcagactctgtaactccatgaagagattatgttccaatgatgttttataagtttgttaaactctgaactcatgagtttatgtcccatataagccacgttacacatggtaggaaggctccaaaaccagggcgccgaaatccatttaacgtgtaacttacctaaatgtaacaatgtttataagaaaaatacattggaagttccagttttgacttccagcaacatatataattcatccactttatttattaacttccatgtgttgagcatcatactggtgctgcgagtacagcatagaataaaagtctctcctttcataaaacatatattgtaattgaaagagaaagacaataaactaatgaagaaaatatatactgtctcaataattataagtgctgtagagtgtagtctacagattgatgtcaatgggtatttgttagacacacagaatctgaggcccctatcctagacccactgaatcacaatctgcattttaatagaatccccaggtgaatcctgtgcacactgacatttgagaaacaccattacagagaacaactaagcagggagatgggatgagggtattattgtctatagtgtggtcagggaagcttgtctgttaagagaacatcagaaaactgatgtaagtgaggaagtgagcctggtgtatttctgggaaaattattccaggcagggagagaaaagactgagcaacgatactgaagtaggaacaagatgacggaatattaaggagatcagtgagactagaggagtgggtcaggggaagtgtgatggaagccatgagagatactcatctttcatagcactgccctacttccttctccccaacatgagggtctcatcaccccccaccactcttgtcttctcctatgtcctccacattgctgccagtatggagagtctgggaatgccctcagctcaaagctgtttggtgatagctggcagagttgtggtagtagctaaaaaagaattaagggaaagaggaattttctcaaaagcaggtgcttttcatcctctttagcaaaccgaaacagatctgagcattaagtcaagatgttaaatacacaaatgttgaatgaaaaaaaaaacaaaaggtagtcatttaaattcagagctgcttttattaaaataagattttcttttttctttactgtggtagttcaaatatcagaataaagaattgtttctattcccgacttcctgacttgcaggaagttaatcagaaataaatgcaatataaaaaaagaaaatctaatttgtattatgcttcttgtatatgtttattatttcatgtactgtattacaatgtaatagaatttataattcattatagcagattgtttccattgcattcctactattaaatatgtagaagctacacatatacttgtagctttaacatatatgtctttatcctcaaaataactgcaaagaacatatagataatttttaaagattaaggagcctgaggtttagaggggagatagctagattaaggccacacagctagaaagcaagcaagcaagggtttcagtccacatgtcaagctccacagcctgtgttttgttttgtggctgtgctttacactatctctctgtccaagaacctaatggaaaattacagatacagatgcagctggccagcagttaatataatttaactcaatcttaaatttatctggagtaaaagtgatacaagtttccgtgttttttcttttctttctttcttttttctttgtgtgtgtgtgtgtgtgtgtgtgtgtgacagaatcttgctctgttgcccaggctggagtgcagtggtgcgatctcggtttactacaacctctgcctttcaggttcaagcgattctcctgcctcagcctcccaagtagctgggatacaggtgcgcaccaccatgcccagctaatttttgtagttttagtaaagacggggttgctccatgttgatcaggctggtcttaaactcctgacctcaagtgatccgcctgcctcagcctctcaaagtgctgggattacaggcatgagccaccttgactggcctgtttctgtgttttttctacttaagaagtagaaaaaattggttcactctatttgaatttcttagaaccatagaaatccaaacttggaataattattgcaattattatctagttgagtattcttcttttatagatgtagaagctgaggcctaaagttgcttgttttgttttatgaacactaaaccaaactaccttgtggctgcttacttaaattataaattataatggggtggccttgcctgagctgtataaattgttttaattatcaggacaaatcaacatactggaaaaaaaaagcaaaacttgcaattgttgttgcttagacacctgtccatatcagtttctattgttgcatagaagcaccccaaaacttaacagttcaaaacgagtgatttattgctcataattctgtgtgtctgaagtttgctctgtgattagctggatagttattctgatggtcttgcttggtgttacttatgtggatgcagttatctagcaagtgaacaggagctagatggtctaaaatgcactctctcagatatctgacagctggctgttggttgcagaaccttgattcttcataaggccactcatcatcctgtaggctagattaggcttcattacatggtattctcagggcagttttccaagagagggcgggtggaagctacaagaccttctgatgcctaggctttgaaacgtgtaggttacttctgctaagttatattggtcaaagcacctcaaaagatcagcccagattcaagagatgaggaaattacttcatctcgtgaaaggaggagatgccacatcgcatatcaaaggggtatgcatattggggatagaaggttttattgtcaccgtatttatacacaaatcactacattggggaaaaggagggaaactggagatcaaaagtgttggtcttaatccaacttaattctcaaaaattaccatgcgttagaaccacccagttcttcgcaaagtatagattactgggcttcaaccccagagtttctgatttactagctctggggtgagacctgcatctctctctctctctttttttttgagactgagtcttgctctgtcacccaggctggagtgcagtggtgcaatctcggctcacagcaacctctgcctcctgggttgaagcggttctcctgcctcagcctcctgagtagctaggattataggcacccgccaccacgcctggctaatttttgtatttttagtagagacagggtttcaccatgttggtcaggctggtctcgaactcctgacctcaggtgatccacctgcctcagcctcccatagtgctgggattacaggcgtgagccactgtgcccagccaagacttgcatctctgaaaagttcctaggttatgctgatgctggcctatgctttgagaactactaccacagacatacagtgagtggggaagaataaattcatcccttctgctgtgtgcagcaaggagtgggattccaatgagatccagtgctgtgaatgctaaagggaaatccatcttattttagcacctctactccccatctccccaccccgaggatgttatagcttagaagttcaaggagatggacaacacactaaaccaggcagtatttgccctgcagagctgttcagtgttcctggatgagacctctgagaagaaaagccataagttcctctagagactttcacaatcatttaggtagacaggactttgcatgggtctgaaggcttgcatggcagatggaggcaaagagccagcaaatctggttgtaaatgtcaatgtgaatcctttcttatccacaagctgctgggcctgagaacattaatgttctacaatacccgatttagcatttttgaaagaaattgcatatagacatgcttaatgtgaagactccaaatcaggatatttgattcaaatgtctcttggtaataactatggaatgaataacccattgtatatggacatatagaagagccagttaacagagttttctttttttttttttttttttttttttttttttttgagacggagtctcactctgtcgcccaggctggagtgcagtggcgcgatctcggctcactgcaagctccgcctcccgggttcacgccattctcctgcctcagcctcccccgtagctgggactacaggcgcccgccaccacgcccggctaatttttttgtgttttttagtagagacggggtttcactgtgttagccaggatggtctcgatctcctgacctcgtgatccgcccgcctcggccttccaaagtgctgggattacaggcgtgagccaccgcgcccggcccagagttttctagttgattaaacactggtaaaatcatctcttcctgtaattaagtttggagagagcaagtctcaagtgtaattaggaaagcacagtattggaggtcaagaagcctaaattctgatatctcagttgtgctaccaactatataagggatcaacagactgtttctgcaaaggaccgatactagatattttctgctttatgggtcatgtggtcaactctgtcattgtatactaaaagccacagacaatacctaaataaagggacatggctgtgctccagtgacactttatttacagaaacgaggcaggtaagatagatttgacccttagtgggctacccatttccccttagcactcagccttcctataaaccatgaagcgtctaactacaagtacctgtgagtcttcctgagtcctttctctgcctgtaggagtagctctcccacttgcagagcaggctggaagctggggaggagattatctctggaatagcacttaaccaatggacaaaagctgggggataaaggtgttggtcttcatagttttcatactgctatgaagaaatacccgagactggataatttatacaggaaaaagaagtttaatggactcacagttccacatggctggagaggcctcacaatcatggcagaaggcgaaggaagagcagaggcacttcttacatgacagcaggcaagagagcatgtgcagggaaactgctctttataaaaccatcagatctcatgagacttattcactatcaggagaacagcacaggaaaaccccacccccatgattcagttacctcccacatggtccctcccacaacacgtggggattattggagttacaattcaagatgagatttgggtgagaacacagccaaaccatatcaataaatatcccaccttcttctccccttgggtaggacacctccaatgcatgttccacactaaaaatctccagtgaattgggcagttgaccacaatgataagcatacttattagcatgcctcgtataggcttccttccgatgtgtaggctttcttcccattttggcagaatctggacccaaccccacatctcctgagtttgatttcagtcctcttcagtattctcatatatctcaactttgttccctgctgagatacaactgacagatatatatgtatcttcagctctgcagctctatcttctcttctaccatggctttctgggatcagctcccaattgaattatttgtatttaaatccttgtctcagggtctacttctgagcaaacctaaattaatacaagtcttagaattagtgccacagttataccttttgagtaagttatgttgcaattcccattttatagatgagataaccaagggtcagaaaggttaaataatttgtccaaggttacagagctagtcagtgacagagtgggtattcaaaaataagtctctatgattccagagcttatgctattaatcagtgcaccatgtatcaagcagtgatttagttatcttcatttgaattttttgaagtctctatttaaattgaatatcaaatcctcacatataaggttatttatacctttttatttgttttatttatttatttatttttgcttaacttttttttattatactttaagttttagggtacatgtgcacaatgtgcaggtctgttacatatatatacatgtgccatgttggtgtgctgcacccattaactcgtcattgaacattaggtatatctcctaatgctatccctcccccctccccccaccccacagcaggccccagtgtgtgatgttccccttcctgtgaccatgtgttctcattgttcaattcccacctgtgagtgagaatatgcggtgtttggttttttgtccttgcgatagtttgctgagaatgatggtttacagcttcatccatatccctacaaaggacatgaactcatcattttttatggctgcatagtattccatggtgatttatacattttaatttgaacttcactcacctctacaaagttaaataaagcattccatttccatttcaataatactttaaatatctaggcagttaaagcatgaggttacttggcacttaaatgtactcttgtcatactacttttgttggcttaaattgcaaaaaaaaaaaatggttaatttattgtgacaataccctacatttatctgcagtgatcattttttttgtgaaaatggccttcgtttatctgcagcaaaggaaaaagaggatggcaattagttcttgcattcttattcctctcttgggtcctgatccttctcattaatagaaacatggcaggggaggggtatataacccacaccctttcctgttgtggttatgtttccactgttgattctgcttcaggtgaacctttaggattaggcaaataaatttccgtgaggccaaatctttttcttcctcattaacagatgatttctctgctaaaaacacttacgacatggctatactattgccggttttatagttacaggctctaaaccttgaaaacttcctcaaagtctaatacgtcaggagcaagcttttgtacaaaaaatgtgaagacccttaatcagttccaataacaaaataaatccattttaaaccctatcccaagatactgcaaggccttggagcagctggagagactccttaactcttgacattaattaattaatttaaaaattcatatttgtatgtatcagtgaggtaagagtgcttgaaatataatgagatgtgtcacactgtagaaaggggagtgacaacagaaagccctggctggtgaggccccagcacttctcacactcatcagaaggaagtctttccatgaaggcagtagggggtccctggtcccaggccaggtccttcaacaatgctcactggttaacaggaaaggcactacagtggcatcattgttaacatccaagacagtgatagaatgtgaaacttctactgtttagtatttagtattcagcatttagatgttaattatccattttgtgatgaagttccctttcttctccctctcttaaccttttggtagttttattgcatggttaccatttccagttagggttgtgctttggggtctgaactgatgaaggaagagaaactctagttcatcatttctaggaaaaagagaaggctaacatcaattctgatgattagagattttttgattacctatgtcctgcattttaacagaaataaaatgttaattacagtaaacttactttaaccttcttatgctatttaacactcttcaagaaaggacttttgcttgaaatcactacagagtataccataatcttgactgtcatactctgaccaagaaaccagaactatttaggcatatttatgagagtaagtaccctaccgctcaaaatggaaggcttcaacatgtattcctaatatttcctaaaacttcactgaatagttttaaaattgaatataactttaccttcagagagaaacaagatttcgaaaggaaattgtagcagttttgtacttcaattgtcgattttaagattgtggtctgaaaagtatttgaacagtcattctttcttttccactatctcaggaaaggctctcattctattagaagcaatcttagaagcgtaactgccaactctcttcttaaaaagtgaagagcagatggagttctaccaatctgctatacttgacagtttttcaactacctaacctaagttccagttactgtctaaattatttttattcgaataggaaaaatacatttatgcttactgtacatttcgacagtgttcattctttgaggtctgttatttaatctccttcccacttttcttttctatcttaaatcagatgagtccccatggtctggcaacaaaacagctgtttctcaaatttttaacgtctctgtggccctcctcctacccttccaagtgttttccatactatttttctgttgtgggcttcagaattggatgctgttccataattactggtcttcccatgactctgtcacatcataaagtctatatatacccttttcctacgtttacatgccaaataccaggtgtgtctagctttaattcaatgactagcatatggtaggtattgcactaatattttttggtcaagtgaacatatattttacagatagatcaaatacatcaaccttcccatgtaataataataataccaagaagattaaatgatcgcgtgcttgaccagctgtttagtggcagaatctggacccaaccccacatctcctgagtttaatttcagtgctcttcagcattcttatatatctcaactttgttccctgctgagacacagctgacagatatatatatatatcttcacaatctcagtagtaagccctatttttttaagattacagtgctgatcaaagagggatattctatggcattgatgcaaatcttccaggccagatataacccctatctccttaaaccctcattcttgactgtgtcttgaaatcaaatttgagaacctctgctttacatgctaccttcctcttaaaattcataaggtttattccttctctcatcttcagtatttttatgaaaatatgttttactcttatttccaaagtgcttgccagcccatgctgagttcattagacaaacaatctaggtatcctaatatttaggtaaaattgctagcagcactaactataccagtacccacttaaattgcaatataaacctacaataggaaaaaaaaagtcaaaattatactactttcaattcctacttctggaataattatcacaccttcaaaaaaactcataattgttctccaatattaaaaaccaggaactaaattacatcactatatatatatagctatatagacatataactgtatatagtttatatatatattacatgtcactatatatggttatatatacagatagctatatctctatatagtttttatataggaaactatatatataaactcatatatatttatatataaactcatatatatataaactcatatatatttatatataaactcatatatatttatatataaactcatatatatataagagattttatatgtatatatgagagacaatattgaaataaaacaaactagccaatctccaatgtcccttcattttcccaggactcttctttattctcaaagaaatgtatgaatacacaatataaataaatgttctataatgttcattatggattataatagttttcttgtcatactgaagtgaatgggaattgtttcttcgattattagcatacttttcataactatgtgatttggtgataggcacttttgcttactaagttcagcatgatcaaaacagaactcctattatttttattgttgattcttatttctttaaggtaaaatatgcccttttcctttgaacctgcacactgtttaacaaataagcacataactcaggattgaattgtacacttcgatttgagcttttttttcaaggtcaggacccagtttcacaagaagttttattttttccaatacaactgacatccactcccaccagctgaaagacaagaaaaacttgtctaataaagctttcagattcaatttgctgcctgcatacagcttgaggaatctctggaggtcactcacagcatgtgttgcaaccccaacagggagaagtaatgaaaagattctagttaaaaagctgacactgccccttccaacctctttgaatgtgaatataataagccagtttacagacgcaaatctctatgattctggggatttccatcttgatctctgactccaaggaacatttgaatgcatggatttgtatccattatctgggtgaataaatgcttcatattgaaaaaaggggtgctttaacaacataagtctgatgtaaatcaggcaaaacaacattgtcacttcatgtttaactctcctggagggtctctaaggtctcacagtttggttctattccagtaatatataggcctatcatagccattttcaaaaataatacctgctttcatttcgattattccccctagcttttgcattgacccgaacatacctaatatttatcttagggctaacacgcattaatgccttgctctgtaccaggcattttgccaagtattctttgtgcatttttctgtttaatcttacagcagccttatgaaataggtactacattattattatttttcaccatgagaggaaatgaaagcctagagagaatggttatccaaaaacacccagctactaagtgggcacagcatggccttgaacctgagtctttataaagttcatgcctgtcttttacctttatgttaaacatactgaatcttggtcatgcagtctatgaatgaagactccatatactctaggaccaattctaccatattgtgcatgcttttgtacatattttccaaatgaaattaaacaacaatactctctcttcccctttcttttccgttttgcatgacatctaaatcttttattaaatctccgtgggtggaattgggccttaagtagtagtacctttgaagcttaatactataacctcagagttacggaagtggtttcaatatgaagaaatatatacgttcttttcttttcttttcttttctttttttggctcctctagaatagaaggcaatcaggagagaaaaagacattaagatgataggcttgattctcccacagtgttactacttagctttatttattctcccacatctgtaactgtcaattcaaggtcaaaaagccagtacagcagcagaattacaaaaagtagatctggaaaatctatagggtaccatagtccagcaccctgctgcaagtcaaaatcaattaaataaatatgtttaaacagcacttcatttaatcttaagggcaccacgactcccttggaaaattcttttttgtgttcagacctgattctctgaaagtattttctagtgttttctttgttcggtggctgtggtgaataagtggacccaattgcctacagcatgaaatcgtagaaatgaatatgggctggaacttcaatcaatcacacaaaccagaaacatagagttcatcacctcttctggaaagcgtccccttcggccgtcaaaagggtagagtttcctccaacatatgttcatacttccctttgcctcccatctgcaatttcaaccagtctgttgctctcgccctttttaggcttcacataccggatttcttcttaggagctcacttgaaaaaagggttgtatgctttaaaaatactaaaagtcactggactagatgataataaaatttctgtaaaataaaaagggagttaacagaggtgttaccacttatcataatggatattgttgacctttcctctagccagtgtcccacttaagcatgcttcttggctggaatttatttttctcatctggataaatctgaagcattatagtaaaacccagtgtgagcaaggccatggatgcaagtggattgagatgaatgagtggatagacctgcgtgggcagaaataatgaggtcagcaataagccataccaagggatgcacactcaaggaataaattggaggtagcagaataactgaacaaatgatacatttgatcagactgtcacatgaatatcaactgaaacaagttatgactgtagttagtgaaccctagagtgaagaaaacaaaatattgaaatccatctgatcaaaaaataataaaattgtttacatgtatatattatctaaaatttcccttaagaatgaagattataaattcccgcagttgaggaaactgaataagaggagaatcaggacagaatcttttctcttcgtattcctagtccatttttcttctaactacagtagtgagaacaagaatttattcaccaaatcataatacattgcaattaggggatgccatttgaatcttggaagacacgatttgaggcaaataaaaaatccatatttataaagtcaattattggtttatataatttactgtttcagcgggaggtataggttagtaatgtaagtcacttcaagaaggttttggtcgaagttttgccaattttttctgtaaaaagccagatagtaaatattttgggttttacaagccagaagatctttgttgaagttactcaactctgctaatgaggtgcaaagcagccataggcagtttgtaaatgcataagtgtggctgtgttccaataaaagtgtgtttgcaagaacaggcagttggttggatttggcccacaagccgtagttcactgacccctgttttagataaatactagtcaatagattccttgtagctaataaagggaatatagattgtttaatgtgtttccctaatcttcttaaggcttcctccaggggaaaaaatatttcttatcatcagcagtgttattaatgcttactcagaacaaagaataccacttacttagcatagaatggacatttataaagccactcatggaaagaataaagagatgtgaaatacctggtacaactcttaagagtgttccactatcatttgaaaaaatgatgagtagtagttatataaaaggactcgagcctaaaacatttgttctcactttggataacgttttcctatctcagcatcaaaaaatacaaagaaaggggataactaggtcttagattttctaaattctcatgactataagtcccatatatttagatattgaagtacccttaaatatacctaagtagaagtaataatttcgatattatgggaaatctaattactgctcatagttctcgagattaaaatgttatacaccacatctcagctttctttgaaacttgaaatggcatacttgtacaaaggtagaatggtctcccaaagcagcgtcatagattagcagaaaagagctatgataatgccacttcaactgactatcatttaaataatgaattagttaggaagagttaaattatatagttacaggcagcaggagatgtcaccatcagggggataagaagccattttccagtacactatttgacttaactggtgcagttccttctttaactgtaggttactcatttgtatccttaatttatcaatatactaatctgacaaataatttattaaggattactgtgtgccctcctgtgtgttagattctagggatacaatatggatcaagataagcgtgattcctagactcctagaaagtaagaaaactaaataactgtacgtgacaaatactaggatgtagaatactagggaagaatcaggaagaatcacctcacccagtctggagtattgcaacagagcgatgtcagaggaaaaattctggaaaaaaaaaaaaaaaaggaaatttgaagatgagacttgaaggataagtaggtgtacctaggcaaacaagtaggggagagtgttccaggcaagagaaacaagtaacagttggaggcaaaatggagcctagcacgttttaaaaatatcagtatggctgaagcactgagttggggttgggaatgggtgaggagcgatgtgtcagggaggacattccagatgatgctggaaatgcatgcatgttcgcaaactgcattttaagacatgttagagaaatcaaacacattttatttgaagggtaattgaaagccactgaagcattgtagagagactagtgacatgagcatatttgggttttagagggattactctggctgaagaataggtaactgattggataagagcaactttggaggctattccagtggttcaggtgatagataataatgacctaaactaaagaagtaataaagggaatggagacaaagtagacagattcaagtgatacttggcacgtggaaacaacaggccctggtaactgattggacataaaatggagagatacagagaacgcgaatagaacacccaggcatttggcttgataaaccgagtagaccgtggtagaaattactaaactatggagtattttagggttcaggggaactgtgagttcaattttagacatctagttttgcaaggccactgaggtaactgagcatatgagtcaggagagaagtttaggctaaaaatatggatgccagagttaaccagcgttatgataaaacaaagctgaagtctcgagggtaagaacacctaaacatctaggctggagaaggcagcaggtaaaaagtaaaaggagaggccaggcacggtggctcacgcctgtaatcccaacactttggggggccgaggtgggtggatcacctgaggtcgggagtttgagaccagcctgaccaacatggagaaaccgtgtctctactaaaaatacaaaatcagccaggcatggtggcgcatgcctgtaatcccagctactcgggaggctgaggcaggagaatcgcttgaacccaggaggtggaggttgcggtgagccaagattgtgccattgcgctccagcctgggcaacaagagtgaaactccgtctcaaaaaataaaaagaaagagagagagagagagagagagagaaacagagaaagagagagaggaagacaaagaaaggaaggaagggagggagggagggagggagggagggaaagaaaagaaaaggagaaaaattcaggagaatggttacttccagggagatggaggcgattgtgctgtggggaacacaagggtggggtcaaggtattagcagtattctatttcttgattggggttgtatttacataaagtgttgctttataattattcttcacactttatgtgtacgttctatgtaatcatctatagataagacagatttcactgtaaaagaaaataaaagcttccaaaagattatcatcacaattgtaacagattcccctggtgcctggagtcacacgccattttcctgcactgcagttgcagctgcagtggacagccctgtgtgagttcagacttgcctttagctgacagcatcccatgtcaagggaatggctcccatttttctactttctatctaagggacttctctgacatcccaggagcccacagattttgtgagctttctcacccttgaagttttagtgagtgagcaaccttcaaccaatggagatgggagcccatggatatatttttaaccactattccttccgggggcaaggggaattctctgtgattctcaggaacatacaaaagttctgtcaaaatacagtccccatggtccataagcattaccttgatgataatacatttgattggcatttcctccccctctgtctcactcttttggtttttcattcttgcttcctagggatcagcttccaaatgagctatctgtacccaagtcctcatccaggccctgttttcaggggacccaaagacaacaataagaaaaatggaactgaaagaggagaagactttaaggcatgaaaaaagttcctctgtattccatactgcatatttaactgcctactcaacagttccacttagatgtctcaaaaataatctcatgatcttttactgctatgaaatgcatgaccttcccctgatatattcctttcttcaggttttgtagcaccacttagctatccagtaacaaaatcttgggggtcattcttaaaaccttcccacctcacccctgctggacatccaccactaagttcagttgatttttttgctcctaaatatttcttggttcagctttcatttttagatttatcctgcatacccctgtacaatctcatcatctctttcctggactgttacagtagtcttatattaggatgatcatagtcttgatttgcctagagaaaacatgctttatgtcattgcctcagagtgactaatagtcccacctttcacttgtaacactatgcaggttattgggttaaataatactgtcatccaaacctaatctctcctcattcatttcttctctcctatgcatcttagctgtgtgaaaattcaaaatataaatttgatgacagacagaactctgtttaaaatgctccagtaccttaccatttatctcaaaataaaaatttcaaaaaaagaaatgatatcccacaggatcttgtatagtgtgaccctttccatttcatcatccttataccagatactgtgaactacttactctcttatctccacattgacctccctcctagttttgttttgcttatgaaagtgcttattttctgttttttaaagccattgcacatattggtctctctgattgagacactatccttttgaatttttgacctcatacctactcacttttcaggtctcagctcaaatgttatactcaggaaagacgctccttacctcccaaactaggttagtgtaaatggcactatttatactcctcttccagagcacacaccaaatcttatatttatttgtgggacaatttgaattcatgttgttccccctactcaattgtgagcttcttgaggacatactctgcctcctccttacctagctttattgaagtataattgagaaataaaaactgtatgtattcaaggtatacaacatgatgattttatatgactatattgtgagatgattaccacaatcaaattaattaatacatctagcacaagaaatagttactattgtgtgtgtgttgggggggggggatgaggacacttaagatccagtcttgtagcaaatttcaagtaaacagtaaagtattattaactatagtaaccataatgtacattagatccccagacatcttataactgaaagtttgtgccctttgaccaatgatatggtttggctgtgtccccacccaaatctcaccttgaattgtaatccctgtaattcccatgtgttgtgggagggacccagggggaagtaattgaatcatgggtttgtttccccccatgctgttgtcgtgatagtgaatgagttctcatgagatctgatggttttataagcatctggcatttcccttgctggcactcattctctctcctatcaccctgtgaaaaggtgccttcctccatgattgtaagtttccggaggcctctgaagccatgcggaactgtgagtctattaaacctcttttctttataaattacccggtcttgggtatttcttcatagcagcatgagaacggactaatacagtaaattggtactgcagagagtggggtattgctgtaaatatacctgaaaatgtggaagtgacttggaactgggtaagaggcacaggttggaacagtttggagggctagaagatgacaggaaaatgtgggaaaatttgaaacttcctagagacttgttgaatggttttgaccaaaatgccgatggtgatgtggacgatgaagtccaggctgaggtggtctcagatggagattaggaacttcttgggaactggagcaaaggacactgttgctaagctttagcaaagagactggcagcattttcccctggcctagagatctgtggaaatttgaacttgagagagatgatctgaaattggaactttgttttaaagggaagcagagcatcaaagtttggaaaatctgcagcctaacaatgtgatagaaaagaaaaacccattttctgagaaatacaagctggctgcagaactttgcttaagtaaaggagccaaatgttaagcgccaagacaatggggaagatgtctccagggcatgtcagaggtcttaatggcagcccctcccatcacaagcccagaggcctaaaaggaaaacatggtttcacgggccaggcacagggccgtgctgctttgtggagtctcaggacttcgtgccctgcataccagctgtggctcaaagaagccaaagtacagctcaggctgttgcttcagagggtgcaggccttagtggcttacatgtggtgttgggcctggggttggacagaagtcaagaattgaggtttgcaacctctgcctagaattcagaggatgtatggaaaagcctaggtgtccaggcagaagtttgctgcaggggcagggccctcatggaaaacctctctgctgggacagtgcagaaggaaaatgtggggtcggagctccacacagagtccccactggggcactgcctagtggagctgtgagaagaggaccaccatcatccaaaccccagaatagtcagaaatgctgatagtttgaaccatgcatctagaaaagctgcagatactcagtgctagccatgatagcagctgggagggggctgtaccctgcaaagccacaagggcagagctgcccaaggccatgggagcccacctcttgcatcagcatgacctggatgtgagacatgtagtcaaaggagatcatttgggcagttcaaagtgtaatgactgccctattggatttaagacttgcatgtggcctgtaacccctttattttggccaatttctcccattcggaacaggtgtatttacccaatgcctgtaccccccattgtatcctggaagtaactaacttgttttggattttcaggctcataggcggatgggacttgctttgccttagatgaaactttggacttggacttttgggttaatgttggaatgagttaagactttgggtgactgttgggaaggcattattgtgttttgaaatgtgatgacatgagatttgggaggggccaggagcagaatgatatgttttggctgtgtccccacccaaatctcaccttgaattgtaatctccaaaatccccaggtgtcatgggagggacccagtgagaggtaattgaatcatggaggcagtttcccccatgctattctcatgatagtgggtgatttcacatgagatctgatggttttataagtgtctggcgtttcccctgctggcactcattctccctcctgccaccctgtgaagaggtgccttctgccatgattgtaagtttcctgaggcctccccagccatgcagaatggtgaatcaattaaaactgttttcttcataaattacccagtctcgggtatttcttcatagcagcatgagaacagactaatacaaccaacatcccctcttgtcgattttcattgaatccccattacctgggaatgaatgaggaaggcagaaatagaaatcagcgtattgttcaatatagaaatcctgaagttacacaagataattacgagcaagactcagtacagagaaggaacccttgagctggggatcagagtcttctggaaacaaggagtaccaaaggggagtgaaaaagagaagtggagaatgagtagtagcagtaaaagaggaagtatgtaaagaaatggaaataaagatgaaataaactgtcatcttgttccagagacaaagctagctaggggagctaaggaaatttagagggataaaaagtctcatccaaaccttcataatgagctaagggctagtttttcatagaccctagcccaacttgcaaccctctcactctcttacttttttcctggctctgttttgctttactgcctttcatataatctaaaatgatgttaaatgtatatttcctgtctcttttctatatcacaatataaattccatgaggccattgcctgtgccacatttaccactgtactcccagtgcctagaatggtgcccagatcaagtagactcccagagtgtctgttgtcaaatgattctcagtccagtgatgtttgcactacatggtgctgccacttttttttttttttttacttcattccatttggaatttggatcattttgccaactttagggtttattcctctttatttcccctgtgtttgctgaatatctgactatctatttttctcagctctcttctcctcacactttgcctccaacttcctctctgctacaaattatacttagcacaagactggagccacttttcattgattttgatgtcagtgcttgagtgacaactccatgtggagaactttcaacctcctgctgtctcgttgtttgctttgaaaaaaaaaaatactcatcttcttcctgaacccactgggtaaatttatgctcacaaaaaagacaaaacttctagaacaaaaactgtatgagcttcaaaagtattagttttcccttgattttgagactcaaaagtaccatagaaattttaaaagggggatgaagtaattttgtcattcaacccgatatattttacaatttgaatgtcagaaccatgaaatgtcttttcagtgtactatcatcctcactatttccacctataaaagaaaagcaaaaatattgtttgagaacaaaaaaatattgcagtagcggaaaaattcactttaagtctttttttggaggttgccacatcacgcctgtcttcagctcctctcactgaagattctttgttttcttgaaaccagttggtcacttccaattcttaccacctataaatcttcctggttctttatatttcactttatatgtcccttatctcctctgatttttgttccagtctttcattttttacattctttgtcatcctatatgtcagaaagaatctgccactccaaattccttaatatatttatctaccagtgtttatttgcctgtcacatgtactcttcagtaatccattgacttgaaaactttctactctgtctttcttactatagtttgcttcttgagttcaaattattaatatattaggtcaagtaattctatttttatgcacattttacctaacattcttggtaaatataattgttttttaaattgcatcacatggtgagtattaatttaagacgtaattagtattaatctactggacaagattttatttattaactgttttgccctttgctagggttctgtaatctcaccctcagtgcctttaaatagtcttacccaaggatcacctatccctcttcaatttaaattctctattgtgttagtttctgagattgcacattctctggtttggtttggtttttcagtgatctctgtggtcacttccaaccatttctacttagtttacttttttccctgttagccctcttcagtgttaatatcacctggaagttaacccattcctagtctgcattgctctatggccagcatcttggctgattggccatcacctatcctgtacttattgtcaatttttttaaattttttattgtggcaaacagcacataacggaaaatttaccatctgtctttgttcatgtatgttgctataaaggaatgccagagactgggcaatttataaagaatggaaggtttatttggctcatggttctgcaggctgtacaaaaaagcatggcaccactaccaacttctcatgagggcctcaggcttcttccattcatggtgaagggcaaaggggagctggtgtgtagagatcacatggttagagagcataaacaagagagagaggggaagtgccaggctgttatttggcaactagctcttgcagaacctaacagaatgagcagtcactcaacctgcccccaggaagggcattaagccattcaagaaggatccacccccatgaccccacacttcccgttaagccccacctccaatattgaggatcaaatttcaacatgagatttggaggggacaacatctgaactatagcattatcttaattcaaataattttactaccaattccatttattagagaatctaagattaagactactgaaactatgccaatgattatctctagttcaggcttctctcttcaattccaaactcatattttcacctgctgacaagctaccacgtagatgttccacaggtatttctaactcaggatatgtaaaattgatgttatcattattttctgaaaatctattcctcttactatattccctatttttgtgaatgacacaatctaatggactggccatgttaaaaatcaggaagtttttctggcactttctttattccttaatattaagccccacgataaattaccaatcctttcgatcttgttaagacaaataagcttgaaatttcttatctcttatttagcactgcaattttgttttctcattcattcagatagcatcttctacaaaacctcttcactagtttttctgtctctcagctcatcttgtacactgcaaatccattaaaactacactttttaacatgccaatcataatgtattagtaaaggttgtataatagttctctttctcttctaggataaaagctaaatttttcagcttggtacacaaggccgttcatggatttggtacctactagtctatctagggtatttcctacatcttccctcctctctcttgaaaaatcaagtaatactaaactatttgtaactccctaatcaccaattgctgcctttatactttaacatatattcttccttttgctagaaatacatttgtcataataggctctttggtaaacttaccattacattctcagtttataatattatttgtgtaagtaccttttttcctacttagtcctccaggggaatgcatgtgcttctctctccatattatcattttaaaatttactcctatttcagcaagtatcataatattttactgagattaattgttggcatatttatgttaccctggtgacatatttaatagttaagatgctttgggctgcaagaaagagaatgcactttcaaagtggcttcaaaaataagaataattcaactcacataactggaagttcagaggttaaagctggctccagatgaagtacaagcagagctctgtcactctttctctatgactttctttgtcctgatttttttctctgcgtcagctttgacctcctcactagttgccctccaggttccaagatgactgccagcaacaaatgggtaacataatttcttgttacagtgagagacataaacacttacctcacagattcagagatttcaccctcagataagaacaatcaaaattttaattgtgtatctactgtatcattagtatatgtattaggtattcatatatatctactattgtactaaagatgattcagaatggtttcataagctggttgatttaaacttttcttcctgaaccaagaggatgagattatcttgactggcttagaatcgaagatttaggtgaatctaaatccatctccagaactgaggatggattccgtagaaacttgaagacaattggaattctcctagaaagcagaatttcagagtgggtgtagggatatctttgaatggaagttgtttaagccaccaacaatattcactccattggggtgacactgggcccaaaggtacccagttaatatttgttcaacgaacctataggaagacaatattatctgcaagctatttataaactaaatgacaacgagaagtatttttagaaaagttaatcatatacaatttagtcattcacattgggaggctcttcctaaatttcgtttctgatccttatcttgatctttgacgcaatcatatcttggcctccatctaaaagccagtagaagcctctggccattttttaaacaattggtttaacaacattaattggaatctatatagctcaacttaaaaaaaaaaaaaagaggaactagcttatcataatacaatattgtcaaggcaagtgatacttccatgcagctattcagcatttggtgtattcttggtttctgcagacctaataaaaagagattatctcagcgtcctctaggtttaattttaaaaaacaagaaaccatgaacaatgaaaatgatttcaaaacatcttcactcacatctaaaatatgaaatagctagatcagaggttcttaataatttaatcggtgaagcataactgaaggatttagaaaaagtgcctaaactattaaaagattcttcagctgctgcttaatgttgatatcaagttattttttacactggcaaacagctaagccattccctggtcacatccacttttcagcatttagcgctcctctcaatcatcccgatcacagccccaggaatgtttcatggcatctccgcaataatagtatattactattgggtcctgaattttgaggtagtttatctttcagaaaggatatgaatagagcaataagtccaagtagagtgggctttattaatgatgcccaagattttagacgtatactataatcttcaatcaattttaacaccacttcccttaccctagttttagtctaaaccagtccaactgtgctgtagtctcagataatacaatgttagattttttttttcaagatatagaattgtcgggaaaacttgtatgtaacctataccaatctaaatttcttagcatttaactctaaagagtaaagcttttagcacttcctgtgtaatacaagggcaagtgctgatttctctgaatataattttcctttgttagcacatatgttcactgtttaataaaaataagaatgcttcaattatctccttttgtcaagggcctgagaaataaagaaatatacagagggtcccaatctaaaaatgttttgatttacaatggttcggcttaggatatttttattttacaatggtgtgaaagtaatatgcactcagtagaaatcatacttcaagtactcatacaactgttctgcttttcatgttcaatacagtattcaataaattacatgagatgttcaacacctttaataaaataggctttgtgttagatgattttgcccaactgtaggctaatgtaagtgttctgaccatgttgaaggtaggctaggctaagcaatgatgttcagtaggttaggtttattaaatgcatttttcaatttatgatgttttcaacttatgatgggtttttcaatttatgatgttttcaacgtatgatgggtttatcaggaaataatcccattgtacgttgaggagcacctgtatcaatataggcatttacacaactctcgtactgatagcggcaggaggcagagaagctctaggcagaaaagggatggtccccagcgaaaaccccaccctcaagccaaaaagcctgaaaccgcagctcaaagtgggaacttatatcccagttttcctgctcgaatgttgcctttttctaaaccacccatggccccaccccaccccatcctgtgcctataaaaaccccagactcagctggtagacaggactacagctggacatcagagagaagcagcttgacttcagagggacaacttgatggcataactttagagaagaatccggctggacttcaggggaagattacttgccacccccatccccttttcagctccccttcccactgagagccactttcatcggcagtacaatccctcacatttacaatccttcaatttgttcatgtgacctcattttccctagatgctggacaagagctcaggagccacaagtgtgaatacaaaaggccctttgcccttgctggtggagggcagctgcctcctgtgaaaagacaaatggcccactgagctgttaacgcctaagctgtccgtggatggcagagctaacagagcactgtaacacaccctctggggcttcaggggtcgcagacgcctccacctagatgctgctccagtgctcatgcactccagttcccacctcgtttgcttgcacactccctccagtgaggagttgagagcagtgggctaagtaaataaggcacccctgttgcgagttccacaaaggggtcagggaaatatcctgcttcgttactaagtaggtataaaccctttactaagttagtaattattcagtaataatacttaaatgaaagctattctgttagactaaattcagattatcaaagacacgacagaaaacagctttctcattcatgaacctattatttccttttgtaaaatatgttaaatgaaaatacagccgtcatgctaatttctaatggtagaacatattttgaaaactcctttatgtttggaagattttgctttagtgcagataatcagaatgatgtgatatactaagaaataatttttaaaatgagatgtgacatttctcataatctaaataagaaatggcaaaacattgtcctaagctaaataactcatatgaagtgataaaatattgctttctaaaggtccatgatatgtagtgatttctaatgtgtttaatagcattgatcctattgggtaattgggtggttctaacatgtaaggaaggcctccagtactaatttcatgtactgggaaactactgggcagggatgaatcccttaactcctaagtaagactatcagatcatataaatctgctttttgatttgcaaagactcttaggcatacctcttgagaatattaaacatctactaaattatatgtaaagcatttcagtctaagatttacaatgctcaaaggagaaagattttaaagttcagcattggaatttccataatttccttccaattgtagaattttacaattgagatagcaaataataatataaataaatatgtaagactgaaatcaacataggagtttggaaagaagactgtatgggttaactagagttgtcaacaaagacttcacagaagattgtgatcgtagacattagtaaggaataaaatgggtgcaaaaaaaagtctaagaaacaacaaggataaatttattttgtaaagagtgaaagcatattgggtattacataaagagactggctagtttgacacaatgtgtacttttggggtaagcagtgggaaatcactttctgtaagtaaagtggaagagaattcaggtattggatatggtcatataggatttttcaacctttgttttgcccccatccctatcctaccagtatcatcacagatgttggcaatattcactcacttgcctgaagatagatattcatgtcaggggctacagatatgtaaaggtgaatgaagttaaatagcaaaattcaagcacactagttctgactgtgcaccctctctcactcagaaaagcactttggaatgcgagagtactcttatattgacaacctttagttggttctaatttataaaaaaatataaaaatatttagacaatttggatattttatatctatgccacaacccattgtcaaatgattgagatatcattgtttggcaacaatgaaactgaaatcaactctaagagtaaagagtacgacttttaaagatatttggttaagagtaatgttgcaaggcagagaccaacattatagaagttctcaacctgtgtgctggatatagctaaaatttcccaggaccattgaaagaaattctcaaatccacaaccacctcaagtgttgtctgtgaatcaaaggagtgatgcattacccacaaacatgtagtagacattttttaagtgatgtagatgctactgcaattaataaatgcaaaattatattacaatattactgaattcagaataagttgattttgtcactatttttctcaatctacgcatgctagatataaagttattatatagagacgtaacatttttaatatttcagaagcatgctcatgatattgtaaaccaggcactgttaaaagatcactggattgggaattaataaacctgggatctagtcctcatttgatctcttgttggctatggtttgggggttttgggcaaactattcaaccttttctgccttggtttaattgataaatgatggtgttttcccagataaatcccttcccaacttaatattaccagatgtagcatctatggtttagaatgtacagtataaattaaccttcctgaagatcttcacaagttactataacctatattttcatggcactgaaaactaagtttttgatagcttacgtttttataaataatttacttactcatttttatcataataataaatctgattcactaatcaccaaaatatcatttttgaaaatagatgcatgaaaggatccgaacttgttatggttttatctgttcaagtcacctaattttggtagccacaggcccccattgtcaataggggaagattatccattttagcaatacagtctctgataacttcagcccatatgcccttcaattccacttttacgtcagattgaatgggaatgtgaggcccccagtagtaaactaaccctactttctctttggaaattggtctttctacctagctctttgcctctgttcacgttcttgtattccacagaaaatatatacattaggtgttaaaatcacaatgattaacaatttttaagtagaaatagttattaagtatagcataatcatgcctttgaattagtacaaaagtaggaaacagagctttagtgacttttttcattctttccaccatttacagggcaaaaatgaagaattttaccaattcaaaactatgcacatgtatagtttccaccagtatttagtagttatgtttctcaagatgtataattcctttcctttctgttttctgtagtttgataaaccctagataggagttaatgttgtttcagttaggtttattatttcttttatgtggtttaatttcatgcaataagctagagattttgtaacataacttgataaaaattttctcccttcgtatctttttgttttaaaataatggattaatatagattgtaattttacagtagaggaaatacattttacttttagttcttatctagatatcttaggaaaaaagaaacatcatttttaaggattattatttttctactaatgaaaaaaatagcatgattttccattctggactttgtaattaactttaccttggaataattgaatcttaaatataacttcattgaaaattttattttcaagtaacattttaaaatgcaaaatttgtgtgatctctactaaaaagaactctcacatcccaatgtgcttatagctacaataattggttaaaagagacaaattataaagaagatataggttgtgacattgaaattacaaaatgtggattagggaagtaagcgtgtagagttttgtatgcaatcaaagttaagttattaccagcttaaaaaacccttacgtaagatgtaaagaaaagcaaaaacctatagtagcaaaagcaaaaacctatagtagatatacaaaaggtaaaaagtaaggaatcaaagtatactactgagcaaaacagtcaaaccataaaagaagacaacaaaaaaaggcatatagaacaaaggatctacaaaacaattagaaaacaactttttaaatggcagtagtaaattcctacctatcaatatttactttgaatgtaaatggattaaattcaccagtctaaagatagagtggccaaatggattaaaacaacaagactcaactacatgctgcccataagagactcacgtcatcttttaggacacatgttgactgaaatagaagagatagaaaaagatattttggtttccatgcaaatggaaaccaaaagagaatggggatagccatacttctattagacaaaataggctttaaaaatcaaaaactaaaaagacacaaagaaggtcattaaataatgataaaaggatcaattcatcaagaaggtataacaattgtaaatatatatgcacccaacattggagtacctaaatatataaagcaaatataaagtgataaaaagaaagagacaaactacagtacaataatagtaggggacttctaccccaaattcaacaatagacagaaaatccacattaaaaaatcaataagaatgcattggactttatgctttagatcaaatagacctagcagacatatacagtacatctcatctaacagcaggagaatatacattcttatcaagtgcacaagaaacaattcttcagggtagatcatatgttaggccacaaaatgagtcctaacaaatttaacaagattgaaagcatgtattttatgtaaaacaacgccatcatggaaaaagtactagtgtaaacaaggtttaaatatgatttactgattgtttaaaaaggaattatcttagccctgatctgatgggatttcccctttgtaagcagcaaaaataagttcataatgaagcaactgtaataatacagcttcacagatctttctgaataaacagagttggatatgtttctacttcagaaaccatttactgtgggctcacagcttttccatacactctttacactcttaattttaaacccattcatcaaaaggattaagacaatgagattcaagtccaagacaataggaagtatgtgcatcaaaactgtcatgctaatgctctgaggaacattgttatttcaatagcataatttaaaaccactgaaaccatgttttatttatgattacctttcatacgttcaaaaagaatttgagatggtttggcagggatgtcttaaagaaacaaacaccaaatttttatttgttgtgcttctaacaagcaatttttcctacgtaagtgttacctgttttctccccttgattttgatctcttttgtatggttggtagttgtcgcacttctgggcatagtatggttttctacaagttaaataaaaacataaattgattttgatgtagctagttccactatttcagttagtgtgttttccatacctgcaattcataacatgtttactgacccagaacgttaaaactcaagtttagttcaatacagtcacttcaaaccaacttaagatagcagttacatttccaaggtcattatgaagacggagttcaagacttcagcagttgaatttgtcaagctcatgggtcttttagttacaggaagtgtgcatatttcacataagaaacagcaactctgatgatacattgaaactcaaatatacccaaggagtgtaaaactactttataagcccttaaacaataaatatgccaacaatcctctgcatactttttgtcattttttagagcattcaattgaattatataacatgtgataccaataaataattaactttttatttatttatttagagaatgattcttgctttgtctcccaggctggagtgcaatggcatgatctcagctcactgcaacctccacctcttagtttcaagtgattctcctgcctcagcctcccaagtagctgggattacagccatgcaccaccacgcctggctaattttgtacttttagtagagacagggtttcaccataatgatcaggctggccttgaactccggacctcaggtgttctaccacctcagcctcccaaagtgctggtattacaggcatgagccacagcgcctggcttataattaactttaaaaaatattctactatcgaatgcctgaaaaaatcatattacttctatgtattaaaaacaaactattacgtaaatagaccagagatacggtgtcagagatgagattccttggcaacagtctctgagacaaaaagttgcacacagaaagtattttgagaagtattgttgctatttataaggaagtgaaggaggcagtattgggcagagagaaaagctcatccacactgcagttgctactgaggcttcagcccatgtgacagggacactggagctgggatggtctttcagagttctaccaaattgaggcaaatgggcgagacttttgtatctttgcactagccaagagcaggcaccagggagaaatgcagctgtgatccttttgtagatattattattctggagtcaatgcaaccacaccacaaatactaggaataatattggtagtgtgggtgcatcgactccagaagaggatcttgatgaagcattacagtatccactacagagaggcactggcatattctgcttaccccacaaatattgcaatgaggatgcaagtaggagtagtgaggacataaaataaatcgattattttccactgggccttaatatatcagaaccattggaatttacaggatgatatttattatagtactcaaaaaaatctcttttaaatctccttaactcagaagggaattttaaaaagtccacaattcacctggtctatgaattcccttttaaaataaaatgtggtttaatcaaatttacaagaaaaaaacaaacaaccccatcaaaaagtgggggaaggatataaacagactcttctcaaaagaagacatttatgtggccaaaagacacatgaaaaaaagctcatcatcactggtcattagagaaatgcaaatcaaaaccgcaatgagataccatctcacatcagttagaaaggcgatcattaaaaagtcaggaaacaacagatgctggagaggatgtggagaaataggaacgcttttacactgttggtgggagtgtgaattacttcaaccattgtggaagaccgtgtggcgattcctcaaggatctacaaccagaaataccatttaactcagccatcccattactgggtatatacccaaaggattataaatcattctactgtaaagacacatgcacacgtacgtttgttgcagcactgtttacaatagcaaagacttggaaccaacccaaatgtccatcaataatagactggatacagaaaatgtggcacatatacaccatagaatactatgcagccataaaaaaggatgcgttcgtgtcctttgtaaggacatggatgaagctggaaaccatcattctcagcaaactaacacaggaacagaaaaccaaacaccgcatgttctcactcataagtgggagttgaacgatgagaacacatggagatgggggaggggaacatcacacaccagttgggggattggggggcagagggagggataacgttaggagaaatacctaatgtagatgaagggttgatgggtacagcaaaccaccatggcacgtgtatacctacgtagcaaacctgtacattctgcacatgtatcccagaacttaaagtataatttaaaaaatgtggttgaaaaacaaaacccacataatacaaactttgccagcttaactgttttatgtgtacaaaccagtagtgttaactatacatacattgttattcaacagatctctagaatgttttcatctctcaaatccgaaactccaaacccactgaagagctcccattgctccctgtaccccagcactggcaatatgaccactctactttctgtctctaaagagtttaactactttagatacatcatataaaaggaagcatgcagtatttgtcattttatgactggcttatttcacttagcataatgtcttcaaggtacacccatgttgtagcataggaaaggatttccttctttttttgtggccgagtaataatattccgttgtgtcctataccacattttttaatccgtttatcaatcaatggacattttagttacttcaatttttggctattgtgaattatgccgcagttaatatgagtgtgcaaatatctctttaagatcctgtttttaattcttttggatatacagatgctcattgatttacactgggattacatcccaatcagcccatcataagttgaaaatatcatgtcaaaaattaatttaatatgcctaagctaccaaacatcattgcttagtctagcatactttaaatgttatcagaacatgtagattacagtacatctgggcaaaatcatcttgcaacacagtacatagtagagtatcaattatttatcctcatgataaatatcatgctgcaacccaatatgtcagaagagagtatcatactgcatatttactagccctagaaaagatcaaaattcaaaatttgaagtatggtttcttaatgaatgcatatcgctttcacaccattgtaaagtccaaaaattacaagttagaccttagtaagttggggactaaccgtacacccagaaatgggattgctggattatatgataattctatttttattttttgaggactggattatatgataattctatttttatgttttgaggaacttccatacggttttccatagtggctacaccttttcacattcccaccaacaatgcagaagtgtttcagtttctccacatccttgccagcacatgttattttctgtttatgatcgtggtcatcctcatggttgtgaggtaatatctcattgtggttttcgttcttcatttgcatttccccgatgattgacgatgttgagtatgttttcagatgcttgttggctgtgtatatattttctttggagaaatgtctatttaaatccttgcccattttaaaatcaggttaattgtttttggtgaattccttattaattactcacctcagagcctttcttcttaaaatacagatttctcagaacctttcatctaatttactaaatgttgatcttgaagaagtattttaatttatctgaatttagtttcccgttctataaattgatagtaatcatgttttccctatccacaccagagtggtatgatgaggaaccaatgcagaaaatgactaaaaaggcatttttatgctgtccagatcttgtgcaaatatattataattgatttgaaccaaaagaatctacattttaagactatttaatattgtcgcatttacattgcactaatggttcctcttttttctcactgatgaagttctagattgaaactctgaggaaactgtaaatcacagttacataactctgttatattaatttatataacttctctgtctctctctaaatatatatatttagactatatatacatatgcatatatatatttagagagagaacgagattacacttaaggactctgcttagtacattgcaacttgcacctcattctaattgtgaaaacaacaacaaattttgattgagaccctgttatttttcagacctttggtcttgtgaggaaggaaaagatgattctgatacttatctcaaatagcttatcatctcctctggtggatgaggcttgtgagggcctgacacatggtagaggatcttattcattatataacaactttcaaaacacatcactaattatttttctgcttaaggtgaaaacgtagctctcccaaacaaataagagatttagactgaattctgtagaaaacactgcttacctcattttgcttagttttcactgcagagtcttgtctctaacattcaggtaggaggaactctattttaaaaaattgaataaacaaacccaaatcagaataaattatttaattcaggagttttttaaggtgctcagaattttggtagaatagcagtgtattttctgtaataagaactacacaatgttctctagctggttatactcaaatggttatatggattttattctgatatcagttttgcaattgatgaccacccttcatcaatagcgtggtctttattatggtttcatctggctttttcttcccttgtcttctgcactgggctgcctacttcttggctcttattattacatactctacttttttcatatacaaaggtcttagtgcattaatagtgagtttctgctaaaagtgttactttcttcaaatatcctgtcaaatgctggctgcctgatttattgacctcatagagtgactatgtgaatcttccattctctgtggaattccattccacattttaacttaaagactccgtcttttccagctgtgttctctctgctggataagcatttttcttttaatttctgtggtaatgggaagggaattttaaatcctgttttgcgtacaagtgtttaacaggtaaaaatggatgctgtgtcagctatctattgctgtgtaacaagctaccccaaatgtagagacttaaaataagaatcattttttttttttagctcatgattcttgattctgcttggggcttggttcatcgaggcgattcttttgctagactcagctgtgctcattcatgcactcgtggtcagctggtagttgatgaccacatgtggcattcatatgtctggtataactttttggttataagttgagacggtgtgggtgacaggatcacttgcctgtaattattcatcaggctagcatagttccatagcggtggaagagttccaagcatagcccaacacccaagcattgttaagcctctgcttatgtcatgtttgctgatacctcattagccgaaacaagtgacttgaccaatccatattcaaggagtggagaaacagactatggctcttaatgggagaatctggaatatctcttgacaaaagtgtagatgcaagaggagaatctgtggacatttactctccagcagagatgttgtcatttttgtcactaagacagttcctgtgtaatattatttattattccttggcagccataagtttgtggtttacttatggatacttcagtgcctgcccaatatcatgttggaaagagaagcccttaacaatttctcttaatttctacttctgaggaatgagaaaaaaaaaattggataggcataaatgatttccagcacaaattctaagcagctatttgagaggtgggtgggtagggagagatggaaaatccttttaattgagacatgctcaaccataagcaatttttctttcctcaggagacatttggtaatgtcaggagacatttttggttgtacatctaggagggagctctggccagagatactgacaagcaattctgatcctacaatgcacaggacagccactcacgacaaaaaattatctgggacaaaaatgtcaatagtgctgagattgagaaaccctgcttttcactgagcgcatgtagatgaattcatataatgttagttatagaagggcacttagatgatgccaactaaaacaggaaaaggcaatgattatttctctattcaagttagtgaaggaaggatatgtttaaagtcaggttggagatatttctcaagggtaatatttaagttgtgagtggatgccagatgcgcttgattgttacaatccatatttttatagctatatcaaatgatcttctctcccaaattaaaatggatattagatatatttcatggataccatatattataagctatagctcttagaagtatttgagtgattaataattcttgcatattgaatgagacatgtaagaaagatacctgatgtcctatgattcttagaaatatgtgcagtggttaagcacattgtcttggaaacatcacttgttaatgtgagatcctgaacaagtttcgttaccttggtaaaagggggatgataacatctaccctgaagatggtttggtaaaggtgaaataaaagagggtttatgaagaaccttgcctagcacataagaatcactgagtaaatgatgggggtgatggcagtgttggtggcaattatcttacttgtaagtagtagcaaatatttatttggattatatttttaatagcaagaaagaatctattaaaatgtaagcaaatagcaccattaagctttaaaaatccatagctcccaaacttaacatttttttttcttaaatccagaaatacaaatggttatcatgaatccttgagttccagtactccggccttgcctatgtagagtacaagcatttatttttctaaaatgagaattattgatgttaggtgtgtcatatattttatttactctttagagtgacagaaaagaaagcagacaaaaataagtgtttatgtgttcatagtgtttgtttctaattttccaacttgtatgtgcagactgtaaatatttagagggaagacatgaaattcttccttacctacacaatagattgtctttcttagaatctagacatgatttcaaattttcttcagaagttctcttgaattcttacggaattcattaatccaaatgccatcctttcaaatattcaaaaagaaaatattctccaatgttgcttacatggaggagagttattttatctactagtgagatggaagtcgctaacaatctttcttataccccatagtattaaatagtaatgcaatttgatcacatataacattgctctcctgttgacatggaatgataaggaggaagggaatatctaacagcactttttagatattctctcatagaattgttaatgtgagcccaataacttattttgtaagttgagtgatttttcaaatataaaagtgaagcaaacaaaaaaagttacccacattcattcaacaaagctagaaatagagtatgtgcttcttgctttcttatcaaccaaaggagacctgtgaattacaggaaaaccatgtgtgaatacttcaaaggaaatatgccaaacacattgtgtgtgtgttttaaaagatttagtagctcctttaaagctctaagtaaagctgttagtctgactaatcatgtacccctgaaaccaattaaattttcagactagagaagtgttcttcaaacacttgaaaaaaataagagttccttcctaaagccaacaccttttaattaacaaaatactcagagcaaagctgtggtttgcaatagtatattacacctactgttattcatgctaccattctggtgtgccaaactcaattcatttcaactattttgagcttgattttctgtctgcttaactatggagggaaaaccacaattttagtagagtcattttaattttctaatgaatgcatgagaaaggtattatgctacatagtatgtcctcagactattcagatgccctctctctctcttgctctgtctctgtctgtctctctttacacacacacacacacacacacacacacacacaatgtgtgtatctatctgtctacctagatatacagtttaattttgtacattgtaatacatctggttctggcataaggtgattgagcaaaaaacaaacaaacaaaacccacccaaatctgttactggaggaacctttaatagcataacatcagaaagactattttcagtaaggaccctaggcaggaaaagacaattcctccaatggacttgagaagaatacccttagtctctgaggtggttagagaggctgagatctgaaccagctaataccagagccagcttcttgtaacccaagataggggcataagaaacggggtgaatgcccaggcatgaacagacttggggttaagattaaatagggtacacgggaaaggatttccgccagctggaggggaagccatttcccatgctccttagggatgacaacaggagacccagcccagaacatcattgaaaattctatgtaataatttatatatcctaactctttacccgttcgttctagattatggattcaggcactcttagcaaaacaaatcctctttcagtcttttaaaatattgacttaacaggaaatatccttggcacaacaatacgaccctgcctgacccttagaactgtgaacaggttgctcagactgtacaaaaccactaacaaatctgaccagcctacacttcactgaaaaaggtgatttgcatatatttctagtactatgacatggtggaaaagaaagaaccgcatatgtgttagataaaggtaaacgcatctgaaagtgcagtaagaatcaatgtgatatatacaataaaataagataaataggccgggcatggtggctcatgcctgtaatcccagcactttgggaggccgaggcaggcagatcacgaggtcaggagatcgagaccatcctggccaacatggtgaaaccccgtctccactaaagtacaaaaaattagttgggcatggtggcaaatgcctgtagtcccagatactcaggaggctgaggcaggggaatcgcttgaacccgcgaggcagagattgcagtgagctgagatcacgccactgcactccagcctggcaacagagcaacactctgtctcaaaaaaaaaaaaaaaaaaaaaaaatttcaggacttcaaaacttctgtcctttgaaacactttgattaaaaaatgaaaaaaatatatacatgcctgaatccagaggcaagtctttttagaaaacataaaatattttaagtaatgtttttctgaacagaaatggctctaatgtgagaggtcgatgaagattagcctcttgcttctttatgttttaaagtatattccttgagacccaaagtttctgactttagaatccaactctcaactactatcagctatcctctagacactttcaaaatcctccaaaacctaatagtggtgcaagattttgtccttcctagtgataactagatttaagtaagaaaacgttaaagactaaaaagtgtttaggacccacaagaaaggtgtaattctgttcctcatggagatattttagttacacacttcttattctggtcctccccaaaacacagaaatctagagttgacatttaaagagaaaatgagatttttgtctggaaacaggagagaaaaagttttcaagaagtatagaaagcgtatgaaaggacacaggtttgaaatggcctgtgctcatgagagaatgcacaatagacatgggtgtggaggagcctggaaagaatggagagaggtaagtctggagggtcaaatctggttcagagtacagagcataaaatcccatacgaatgtagaacatgaggagccaataaccattgtgtgagaaatgcaggaaaaagaggaagaaaaaaatccacatagtgtacttacagtcagaacaatcctaggaggtgacttacatgtatgatgtcataaaatccgtaacacaattccattagattggtactgttttcatagttacacaggtgaaaacttttgagggtcaagatgttcattgtagcaggcatagtataattccttacctcaagatgcctccaatgtcagtgaacattacttttccaagattgtctatttaggaaaaagtaaggccagttgtctatgaaggaagtactattataatcgccactttacagaggagtaaatggagattcagagaggttaagtcatctgactatagttacacagctaaaaaaaaaaaaaattatagagcaaggattcaaatacaacaatctggtcctagaaagcctaaatattctacaccctgctttctgattcagagctatttcctgcttttctcccttcgataggaaaaaaaatgtatgtgtgtggggttgggggcaaataaattgactggctgtattttctctctttaatatttgatctttcattgtctgctccaagcagtgggtcttcctccattatcttctcgtgaaaatagctaaaatcacctaactagtaaaaacctaggcatgttttgtgttctagcctccattcttccattctaatgggtggctgttaaattttagtactcattgtatgtagaagacctctaagttcactaaagagcttactgcacattgacttttctttagattcaaagggaatcaattgagcacctcctatactccaggacatgtgcaagatgcaagagatagagcagtgagaaagtctgataaggtttcccctccctttcccagcagtgtacagatagatgttcttcaggtggtgcatgctggagaagagaagaccagaaatactggcctgacgggtctatagatgagattatctgcccatgactggcgcagggatggccgcattgctagacctctccatcatcctctgaatatgcttcagctaatttatcatcccaatggcatatttagtcatcatgaaccattctctctttttgagtctcaggccctggccttgcttttcaatagacttccaatagattccttcctccttccttcccttactgcctggcttcctgacttccttccttcctgccttcctgccttgtcttgccttgcttttcaatagattccctccctccctccctccctccttcctccctccctccctccctgactttcttctttccttcttcctttctgtctttttccaaacgtgcttttcaggaaacagtggtctgcttgttgaagtctgataattctctagttcctcatccttcactttattgaaatttagtgtgacatgatcatttccacctcattaggtacttctttcatggtcagaagtaagtctggagaaaaaaaaaaaatctcttgtctctgctcttatttgagggtcaaattttcaataagtcactttttaaaaaagcattttctgacacttcccataagcttgaaatcctcctaaattgctgtatattgcctcagtataccttgtgtatctattttaggaacactccatccacatttgccagtcagcctggtgttctgcagttagttcctacagtgatattttaatttagctctcttttcatcctcacacatgcatcctctctggatatttagctcctttcctggaatcccttttaagatttctagatctttttgcttccatgatttcttctcctggactgtgacacaaaatgctatttcttctttacattacatttaattctttctagaaagagcctcagagtagtcagatagctttgagaaacaaaactttttctttattgcctcactgttactgcctttcaatcattgtttcgtgacacaaatttttttattctctctgacaattaaaacactatttttttctgtctgcattgatcaaaattagttccttcattcatagaaaactcttggtgtccctgagaagcttgagagacaagaaacattcttccattctactcatcttcttctctaatgaggagacaaccttaaaagcacagttacatagccataaaaattaatgattggctacctcagaatgaaaattcaatgtctcatttttttttaatattcttagaatcgttcactggttgtccagtgtgagtctcctgttgagatgtcttttgcagctttccttgaaacctttcattccaaactacatagtccaataattttgccaccaatcttctggttatattatgctcttgagtctgttgtctataaacttgattaggcattccttcccctcaccactcacctctgataacccagctgtgtgttggtatttagtatcaattcacaccagcaagttcagccctcttcaatcaatatagggccacacacggacttttgactgactactccccaagtatttcacattttggggccttatctccagtttctcaccacagttgttcatcactgtgtttcttactagccaggcgtttataaaaacagtaatacctaacactattgatcacctactatagtgtcaggcgctgtaataatattattgtgatgatgatgattatgctgctctttctggcattgtcatacgtgtattgcttgtactactcactgaatctacacaactgcccttatgacatttaccctgttattattcctcttttaaggtaaatacatgaaaaatgcttcccactttgccttgcttactgcttattgctagtactgaacaaatgttagaactgaaacttagagaggttatgtggctttaccaaggtcccagagttcctagggcagagaacaggattgtctaccagacattttaattctagtactatgcatcttaaccattaccataggctgacttactctacagtgtccaacactattcatattaagatttatttaatgactttgaaacagtatttcatgtctaaatagaaaaactactaactcgcatttttaagaaaatattgtatcttggtttttcttcactgctggccagtttactaacaatctgaaataaaaagaaaaaaatatgataaactgctcccagtataaaatacagagctaagacaagaacgtttcattggctttgatttccctagggtccagcttcaaattaatttacttcctattcaagggaattttaaatcagaaagaagatcttatcccatcttgttttgcctttgttttttcttgaataaaaaaaaaataagtaaaatttatttccctggcaaggtctgaaaacttttgttttctttaccacttccacaatgtatatgattgttactgagaaggcttatttaacttaagttacttgtccaggcatgagaatgagcaaaatcgttttttaaaaaattgttaaatgtatattaatgaaaaggttgaatcttttcattttctaccatgtattgctaaacaaagtatccacattgttagaaaaagatatataatgtcatgaataagagtttggctcaaattgttactcttcaattaaatttgacttattgttattgaaattggctctttagcttgtgtttctaatttttctttttcttcttttttcctttttgcaaaaacccaaaatattttagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggtatgagaaaaaatgataaaagttggcagaagtttttctttaaaatgaagattttccaccaatcactttactctcctagaccatttcccaccagttcttaggcaactgtttctctctcagcaaacacattactctcactattcagcctaagtataatcaaggatataaattaatgcaaataacaaaagtagccatacattaaaaaggaaatatacaaaaaaaaaaaaaaaaaaaagcagaaaccttacaagaatagttgtctcagttaaatttactaaacaacctggtattttaaaaatctattttataccaaataagtcactcaactgagctatttacatttaaactgtttgttttggcactacgcagcccaacatattgcagaatcaaatataatagtctgggaattgattattatccactcttctaagttgtctgtgccaatttgccttctccaatgataaggataattgaaagagagctataacttaaaaagagaaaagtaacaaaacataagatatttaaaattaccctagatcttaaagttggcatttatgcaatgccatgttcaaatgaacatgtttttaatacaaatagtgcatttttcagcctcagtgtaatccatttggtaaaattatgacatcaactagaaacattagaatacattgatgtaaatatggtttacctagctagatcaaatatactatatatcttttatatttgtgaatgattaagaaaaataatgttggaattgttatacattaaagttttttcacttgtaacagctttcaagcctttctaaagaaatacaaagttgtgctgaaggtatttaggtattaaagtactaccttttgaaaaaacaagaagtgaggcagacagagtaaggggaatttctttgtaaaataaacttcaccaattccataggaataaaagtaatttgatagtaaacaacctgcatttaaaggccttgagcttgaatacagaagacctgaattcagtgccatttgcaaatgatgattgtggtcaagccatctctggatcttcgtttcctattctgagtacagagcatacagagtacacattcacattcacaatatagttatggatatggatgtatataaatatatgtaaatactacatatatgtacctaaaatttgttttacttctgctttaaaaaaagtaattatagccacatttttcagaaaaagtaactgaggctcatagatgtcaaattcccagtaagtagcagaacaaggattcaaatccaagtccatttgattcctaagcttgtgttattacttgctactgcagagagtatacgtagcaagtaatatatgtactgcaagcaatacatactattgctgcggtaataactgtaactgcagttactatttagtgatttgtatgtagatgtagatgtagtctatgtcagacactatgctgagcattttatggttgctatgtactgatacatacagaaacaagaggtacgttcttttacaataccatattgagttatataatactcccaggacttttatttaccaaaggaaacaatattttataatgtttaaagcccaggttttgaagttacattgtctgggttcaaagcttggctcccaagctgtgtgaccttgagtaagttattctgcctacctgagcccaagtttatctagctataaaatggggatagttgtactatctgccttgcagtttgtcatcaggattaagttggttggtacatgaaaaatgcttcccactttgccttgcttactgcttactgctagtattgaacaaatgttagtaattatatttggttccaccacgaactctagaaatctaaccaatgatggcatttgtattatgcaaactgtatatcacatcataatattatatggaaatgagagcttgtttccgcttctgtagcctagtctaccattgacatagcttcctgcagaagttaccagataatagattgggagagaaagtccacacttccttgtgacgggtttgtgagtccagcatttagggaagccattgatgtgctcagtagtctccagagttctctaaataaatgtgtccttttcagaaaggactactgatttgatgccccctcacagagatcgtctttaaatataggtcaaaaactaatgtagagggccaggtgcaatgtttcacgcctgcactcccagcgctttgggaggctgaggcaggtggatcacttgaggtcaggagtttgagaccagcctggtcaacatggccaaaccccatctctactgaaaataaaaaaattagctggtgtggtggcccatgcctataatcccagctactagggaggctgaggcaggagaatcacttgaatcctggaccagaggttccattgagctgagatcacaccattgcactccagactgagtgacagagtgagactccatctcagaaaaaaaaaaatttagggggaaaaatcaaaagccatttctgagacacaaaaatacaggatttataaattatatatggtatatataaaaatatttttaaaatagtatatatagcatattatatataatgatatgtaatgttcatatattacatatttataaaaaaatctaatctcccttctcttgcttgctgaatagggggatgctttgcctgcctcttcctcttatattaaaaaataattcttaaagacattgtcagttcttggcttttatagcctcaatcaccaaattgtcggtaaaatggccctaaataatcattaaacaaatgtgtgtgagaggggaaataagaaggataagtaagtatggggaggattttgttataatttcaggaaatcaatatcaattttatgtaaagttttaaataaagcaatcccaactttaatgtttgatgtgtgaaaaattaggcaaaattccaaaagggctttataaactgaaaaaaactttactaacacctatccatttttattattttaaccaacttctattgagctgccactaagtacctgggaaacataaagttgtacaacatagaatgtgcaggtaaaagaggttgaaggaagaaaataataacactatgatagagataaattttaggataatagctaacacatatgatatgccagtcattgatctaagtacttcacgtgaattctttaatgcttacaacattactgtgaggtagatagagaggcacagtaaggataataacctgcctgagatcgaggaagaaagacaatgatgagatgtgaactcaggcagtttggttccagagtcctctcccttaaacctcatagttttcaacttctctgatattgtgtgggtgatgctgttggggctttcttcagggaaaactaagccaggagagagaatggatgctagtgagatattcctgaagaaggaaaaacttaagccaggcattaaagaatgagttggaattacctagctagataaaacgagaagggcaatccaggcagagggaacagactgtgcttttcactgaggtggaaaaaaaacagagtatatcagaggaattgtgattccatatggctgaagttaagggtatatgatgaggaagaaattgatgaggttgaatagagaggactggggctaaataatgggaatcctttgttgccagactgaggaattttgatgatggcctacaggcagtggcaactctgaaaggattgtaaacaggaaaataaaatcatcacatatagtttagttgcctatcaattagagctctctggatgcaagcaacagaaatcattctctgattaaatcaggcagaaagtaaatgtgctgtaattagcacaaaggcattggaacaaaacttacaaaaggaaaaagaatctgagcatgcctttctgggcatgtggctagcaagaagtattccagtctgtttgtgatactctcttttctccatcctgtgtgtaactctgttcaaattttaaagtcttaaaagagagtccagttcaccttgtttgggtcacatgttaatacatgagctagaagggagcagaaaactttgatttaaatccctctcctcccaaagtctcaaaattagggaaaggcaattctcctgaatagaaactgggttctattgacaatagaagaaggaaatgattctgaccaaccactaaacaataattgtccactgaactcagtcaagaacatgtagaataagttggaggatagagcaaataaaggagatttgtaggaggtaattattatgatctaaagcaagcttgttcaactcatggcctgtgagccacatgcgtcccaggatggctttgaatgtggcccaacacaaatttgtaaactttcttaaaacatgagatactttttgtgacttttttttgctcatcagctatcattagtgttagtgtattttatgtgtggcccaggacaattcttcttccagtgtggcccagggaagccaaaagattggatacagctgatctaaagcaacaggttcatctactcaacttcacaacgtgtagacctgaaataaagaccattcatataccaatacctgaaatataaatttgtttgaccatgacacgtacagtaattggttctcaataaatgtggatagcttgatggataatgtgaatgcaatgtgataaggaaacttcatattcaacaaagactggaatgtgaggattataattccaaagcaccagaagatagataagataatgcaatgagacattttatgactcaaggcaaagttagttatgagattcagaccaaaccttagacgtgcagtaattgaaatatttgccacagaaggggtataaggacatgacattcaagtaagctaacctttcactagctttagactttgaactcagaaaacatatttggtgaaaagcttatggtcccctttagtatgtattgcttgattaaagtattattttagaaaatggtgagctgcttccattttgaaataaaaataatttttactaagtgaattatattcagtgaaaaaaatggaagctacaattacaactttaatttttttaagttttaagaatacagccatttaaaaaaattaagcaaatctgcttcattttagacagtagaaaatataccattatcttttagaagaatagagatgtgaaatatgcaaattaagcctttagaagtaaagcacacatgaagttcaaagtttaatttctagaattgtgaatcaatagcagtggatgatttgtactttatagcttagtgtcggagaaatctgattaaaaaatgctttttctgtttcatcacataaacataagtaaaattgctctgaaacaacaatatttgacaagaattagcagttttcttttttgacataatctatcaaatgaagggaaaaatatgtcctgggttttgctttgagagtgattactaaatctgacccttaaggaaaggaaggagagaacaaagaagggaggaaagaaagggaaggaaggaggaggaaagggaaaaaaagaaggaagagaggaaggaaagcaggaaaaaggggaaggagagagaaaagacaaaagaaaggtagcaaggaaagaaaaaaagacaagaaaggaatattaaagaggacaaaagaggagtgaggaaaggaggaaatggaagagggatggtgggagacaggagggagaaaggtggagggggaaatatgaagagaggttcccagcagtggagactagtgttgctatcaacaaatagaatttagatggccatatgatattatttttcataatactggtgtctgattgcctgtgctgagttaattgtagtcttttttttcaattccgtttggccaggtgttcaggataattcaccacaaaatctcaaccactgcacttgtattgaataaagaattgagttggcaaaggcattttatcctccagtaagacctttccagattggggttgagacaaattggccaatctggacaagatgataatagcattgttcaagattaatttttaaccacacattgcactgttacctgggagatttcattatctaaaaattgaatgagcagttttagtgggtatagtgtatatttaaatgggacataattacttgaatgagtttaatttttgttgttgttgttaaggtcaaagtacttaaaaattatgattttttaaaactctgtctatacacaaaaagcatttgaattagctacagaataattctgattataacttttggtgaatagattcagtcaaaatctgattactaaacaacttgtgtagtatagccctggaagaattgatgggacaatgtgtgggtaaagtggcattggctatttaaactaaaagcaatacaaaacagaatgtttcttggttttattctgttgtcacaaacccagcagaaagtggctattacaatagtttcccttattcaacaaatgagagaagttatagacaatttagttaattgatctaaagtcacttagtaaatgtaattgtcctaacataaacccagacccccagacctcttgggaatagataatgtttcttacttcttttctatttcctcagccacccccctcaacttcttacacatctcatttctccatccaaattataacaaaacaaagcaaacatggtttatttccatgggcatcaaatggatttcacgaggttgggtgacagtcatcttagggtgaggagattgattattctgtttttctctttcatcgatcaacaatccagcccttctcatctcatcatttcatttctgcacaaacttgtttaagaaataccaattaagaaattaattaagaaattaatgttgtaatctgtttggctgaagatatttacaaattttgtgctttaattatcttccaacaaatgtacatgtctctggtagacagcttgcgaccatctggatgactgatccatatttatataattttctttctttacctaatgagaccaaatccactattatcttcaacgaaggatgtaaagatatgtcagtgtcagtaatgtgacttattttatattctctggtcataacaaaaataaaccgccccttaaataaaaaggtcatagagttgcaaacacacacacacacacacacacacacacaaaatcatattttctaagtctcctaattacctttttatggaaaatgataccatatgcttttttcttaaagaaactacataaacttataaactatactaaactacacatttcaaagtctatgaatggaaatgtgtatcttattatattttaattcaattcactgtaaacttttctgtcaaaatcttatcaagcaaaactgatccaggatatttacatgaattctgatggaagtcactgtactgtgttttccataaaataccagtgggattctgataaggaagtttatgtttgccattgtgtttaaatagagaattctgggccgggcatggtagctcacgcctgtaatcccagcactttgggaggctgaggcgggtgtatcacctgaggtcaggagtttgagaccagcctgaccaacatggagaaaccccgtctctactaaaaatacaaaattagccgggcgtggtggcgcatgcctgtagccccagctactcctgaggctgaggcaggagaatcgcttgaacccgggaggcagatgttgcagtgagccgagatcacaccattgcactccagcctgggcaacaagagcgaaactccgtctcaaataaataaataattagagaattctatttacaaatttcctttcttggatctagttagggctcctttatatggagtgatttttattgttttcatagaaatacgtagaatctgggtcttctctaactttcttacaggaaagcaatgtaataaggtttttttttaattttctgaaagttatataatgttattgttccctaaagtttaggacctgccttttaggctttccatttcaccataacttttggtccttaaagtctgtaattgaagttacagtgtgttatgatgtaaatttttcttattattacctttaatgttagggtaatgttaactaatgttaatgttaggtatatggttgtttttttcattccttcgttcaacaaattgtctttgaaacccatgttacaaagcactctagagtcaggttgaagactattaagaaaggagaatagaaagagacactagagtaataatttggatttaaatttgatttccttgtgtatgatagtgaataagtgtgaataagatgaggcagtgatcacacatcactattagtaaaagtgtttctgtacctgtatccacacttttatgtatatggttacttatgttaaagtgatacatattatataaaattaacgtatacattaagtagatattttaatagtctgtaattaaatactactagtattttctttcctccttcaagtgcttacttttgatacctcgagttacagtgtcataaagattctttagaaatatattgactgtcttttaagagcttttgatacaatactgagtttacattcatctgttatttattgaacacttgctggtgaaaggcatcagtgttatctgctcttagggaacaaaaattaaaaagggataggccctaattttagagtgtatcctctataagaaaaacataaaagatagggcagtcatggccacaaaagaaaaaagtgttatggtggtttcaatcatatatgtattagaatgaataaatcaactgatcaattgtgatttcttattctaaatatgtgcctgcctttttcatatagatgaaaattaagctatgtttatctttccagggatcttgttgatttttattcaataacttgggagtgaaagttgatttttgcatatgttttaatgtttttaaatttcataaatgaattgatcagtaatttccaaggtagtaatggctgcattgtttttgaaaaaaaaaaagcaacaggatttgattgtgcttttatgatttttaaagaattcattaaaaataatgccacggtttctaaaatgatttgagtcaatttcttattcgatttataaaaataactttgaatacaattttagtaattcacaaatgctttcagttcccttacctttatattttatattctgtgtaaacaagtgacataatatttaagaattatatatctcctatgatttattcaagaaaagaatatatactgtattatttatttcaagaacagaaatgctttgatttaactgtcatcttctctcttcaattatggaagcaaaataaactgtaatgaccaatgtaacccctcccccatatcaagttaatctatgttcaactccagaattatttttgaacactcaaactagaaattaaaaaaaattaaatccatgaagacgatttttgccaaaagcatatagataaattgagttgattctatacttaagaaagtggagaggagagagtaatttggagagagtaatttactcttaatcccatattttttccctaaatgtgaaagaagtagattgtagtgagagggaaaataacctgtagcaacttcattgaggctaagctttctgtcatgttatattatacgaaagtaatgaaatgcttccacagatagaatcagaagtcccctctgagaaattctacataaaaattagcctgccactttaccacacttactcaagtttgatttttttaagttatgtaatagatgttaggcactagaagaggacatttactgggggcaaagatcagtagttggaaagaatgcaagcaggcaagaagctatatataatgagattttacagtacaattgttttctaaatgaaaatgaggacgggtccagacacaatggctcacacttgtaatatcagtgccaggatggaggatcccttgaggccagaagttcaagagcaacctgggcaacagagtgagacttcatctctacaaaaaaatgaaataaaaagttagctggctgtgatggtgtgggcttgtagccttagctactcaggaggctgaggtgacatgatctcttgggcccaggagttcgaggctgcagtgagctatgatagcgccactggattccaacctgggcaatggaacaaaactccatttctaaaaaagaataaaatataaaactaaaataataaataaataaaaatgaggatatattttattttaacatttggaaactttgtaggtgaggaccatgcaaacattcaaggtgtgagttctgaccaaatccaattattaaccataccaatgacttaaggtttcttcacactccttaaagttgattaatataatgattatatagttgactggtatgtcacagcttgaagcctttgagatttattcctgccttttctgtaaaggttgttttgttaattccagtatgtactggtcgtttttgttttgttttgtttttgtttttgttttgtttttttgagatggagtctcgcactgttgcccgggctggagtgcagtggcacgatctcggctcactgcaacctccgccacctaggttcaagcgattctcctgcttcagcctcctgagtagctgggattacaggcactcaccaccacacccggctaattttttttatttttagtagagatggggtttcactatggtggccaggctggtctcaaatacctgacctcatgatccacctgccttggcctcccaaagtgcggggattacaggcgtgagccaccgtgcccggctgccaatatgtattggtctttttcatcaatgattcagtccaaaatcattttgtcctttaactatatattttcttgtaaagctgcttctgttgtcttgaacttttcttttcaaatgtatgttgtcatttgactttttagattgttattttctggtcctcgaaataaatttaaatttcctgtaaaggaaggtgtaatattctatttgacatagccgctaaagatgtactaggtgctttataaatattgttgatttactttatcttcacagattactagttttacttagtatttggaatatgacaacattttatagagctatattcatatatatgtttatcttaactgttaaatgcaatatgattcatgtcttgttttggtcaatgatgaatgaaagtctcctgagaattaaatttactgcatcgatgcaaaaacaatcataattttagacactctaagaattttagaaattaaaggattttttttttccagtttactctgttaagattgtgtttagctatgcgtgacagcattctcactacagtggcttatccagatagtttctttttctcatagagcaagacttccagaattatgtgttccagggtcagtgcagcacctccaaaaccgtatgtcccaactttttcctccaaccccagtcatctccaacatgagactttctttttgttttgttttgttgtttttgtttttgtttttgttttgagatggagtctctgtcgccaggctggagtgcagtggcgcgatctcgactcactgcaacctctgactccctggttcaagggattctcctgcctcagcctcctgagtagctgggattacgggaacgcaccaccacgcccagctaatttttgtatttttagtagagacggggtttcaccatgttggccaggatggtctcgatctcctgacctcatgatctgcctgcctcagcctcccaaagtggtgggattacaggcgtgagccaccgtgcccagcaagactttttttcctgtggtctcaacatggctactctgcctccaggcactatgtctgtactttaaaatggaagaagggaaaatggggaaagtaaaagcatattccagctgtgtcagctcctgtttgtaaggaaaaccagtgcttttctggcagccccacacagaagagtttctacttgaacagtgcattaaccagaaatgtgtcacgtgaccattcctaacttctaaggatcttgggaggattgagtgttttaactgaataggtgtgtttctttcttcataattcaaaatgtgaaaattggtaacttagttataaaaccttgctagtctgaacagaatttggatttttttagctaagaaggaaagaaagggtatcggataggcagctggctatgctagccaagatactcttaataatgcacatttttcttctttggacataagcagttttaacttagctaaatatgatgtgattgttttcctgtcttcttagttctgtttaaatttgtttcagaaatcaaggaaataaaatggagaaaaaactctattattcatgtctatctttctgcctctgaatatttttatgttggagaaagagaaagcagtaactttcataatagcttacatagtctgacaaattctaaacatgtccgttagcatcaatatacgtggtattaggtcatcagtttttatattctgaattattaagacccaaataaacccactgagttcaagagaaagtatacactgagcaataaaaacattaccagttctagcaatgataatcaaacaagaaaacaagtaatatagtctgtttagaataacatgttttaaagatcaagtttttcttccttaccaatgttgcctttcttgtaacacttttttttccttcttgagataggctttcctatcttttgtcacaaaccccaatatttacatggccattcgtagtctattcatagcagcaccaccccatggcccaaacttgtagatattgccctccttctatggttgttctaataagaataaccactcttgtctctcataatctcagctgttttgtgccgttaaaatggaaaataatgagtattaagatactaactaggggccaggcgcggtggctcacgcctgtaatcccagcactttgggaggatgaggcgggcggatcacgaggtcagaagattgagaccatcctggctaacacggtgaaaccacgtctctactaaaaatacaaaaaattagccaggcgtggtggtgggtgcctgtggtcccagctactcgggaggctactgcactccagcctgggcgacagagcaagactccatctcaaaaaaaaaaaaaaaaaaaatactaactaggtttcagtcatatgagatgaataagtcctacaaatctgtacagcctagggcttgtagttaacaatgttttatatttaaaactttgctaagagagtaaatctttttttacctgttattatcgtacatgcaaaaataatagtaaataaggaaggtaagagaaaaattttggaggtgatgcataggtttatggcatagattctggacatgatttcacaggggtatacagtcatgcattgctcaacaacagatatacattcggagaaatgcatggttagctgattgatcttgttgtgcaaacatcatacagtgtacttacacaaacctagatggtacatcctactatacatctaggttgtatggtatagcctattgctcctaggctataaaccagtacagcatgtgactgtactgaatacttcaggcaattggaacacgatggcaagtatttgtgtatctaatcacatctaaacatagaaaagttacagaaaaatattataatcttataggaccactgtcctacatgtatacagactgtgcacatgatagtggtccattgatcaaaatgtccttatgcagcacataactgtaattatctcgaaactcatcaagctgtgttcattaaatgtgtatagctttttatgtcaataaagtggttaagaaatcaataaagtggttaaaaaatattttgactaggaaatatactatcatttctagttgataaaagatctcaacatttccaaaattgtcctacagaaaaccaggttcatcaggtgttcatacatgatcctcatgaaaaggtcaaataagctgaaaaacatgcatagacgttgcctatcctagcaatctatgatgtacatctccatagtaaggtcactgaaaagtcttttaggaatgttagtattgttagctcagtatttctcagtgatttctccatggaaaccatttgtgtagagcatcttgaggagcacagctgagagaacattatcttagttggatgtgtatgtccctctgagtcacttgatttctctacatatgcttttaccaaattaatcttttagaaatcttttctcttcgcactatgtctataatttgtgaagttgttaccaggataacatttgtgcctctcaccatgatgtacctaccagggtccaagcagccattccttctctagagcaactgtctgagggaaagaatttaacacagcattctacgaaatcattttatttataaaaatagattactgctttacatatagtaatttatatttagaatattgattaattattaaaatctgcatgagagctttaaagagtagtacataatatatagcagtttgtactcaaactgtcttctaaaaaggattcactttttgtttgtattctattgtcctattcgttgatagtgttacgtaagtaattataaaacttaaaatctggaaagagaatgtggactcagaatgccatctcttttgttatttcaaatggattagaaatgaacatacatattcattttctttcattacacatccagagaaatagaatggattttataaatatgtaaaagcaaggattttgatcactgataaaaagggaaggtttggtcactaccttatttcattccttttttcttatccttttttttttttttgtcaattatttgatgacatctctgaacatcaccttttattcatgacaagaattgggtatcatggtaaagaacactgttaatataattcagttacttcaccccctcctgaaatatagagaagctttaagactatgtgaatatttttttctggttttcttgtatttgtagaaatagcatgagctttgtttaaagtcaggcatctaaaaccttgccctgtatgttattgacaacctgcacaaattttaggatctattctattacagtttgttcaactgtaaaactaggatagcaaactctatgtcatattttcgttatcagaatttaaaaagcatgttttaagatcttagtaaataataaatctctactctgtagttgaatttgttctatattctttaagaaattccctttgatggttatgccaacctctgtattacttttcttcacactttaactttgcgctgaaatcatagtagtattttacgttatcagtcaaaataacagtcatccttaaaacaaatatgaattttagatgattaaatagatttgtatggaggttcttcttgctaatcatagcagttatccttggtgaaaaatgatagacacttgaaaaaaccaattaatcatgatggctatttttgcatcataaataaagctttcaaatttgagagggaatcaaaagggcaatggtagtatagtgtctcaaagcccctttccaattgatggtacaaatttaaaaagagagagagagagagaaacatgtttcactgtaattgttttctaagagcttccaaaaaagcgtattttcttaatagattcaaatttttcagttggattgaaagggaagtcttggagtgtagtgaggagggcaccttctgttgagaggtgttcagacgacagagtgtgcccaaggccaaagatgagatggttttgcgaaagtcagtggccacaaacaggtgtgtttgacccctgagagatatgcaggaagtctaccccactttaattcttccaaatattctttaccttaattcccaagtacttgataaaggagcaatggggagaaaatatgcacactattatggaaaagttttgacctacactttggagagttttagattaagagcattctagaaatcagtcccaaatgcctagggtttacttacttaaagataatatcatagtttgggtgactgggaagcataccctgagattgaggtgagcatgcagtatgtctatttaggagtgttcttggggtcaacgtgtaggggcagagggagaagttgagctctgacgcagtcttagtaagggcctcagctgaccgttcagggagttcttaagctggaatgacccttcagaagtgctaggaaacgaagaaaggggactggatctttataaccccgtgtcaagtcatgcactggatgtgggctactccaggaaggcaacgaactttagcaagatgattctctttagccacgggaatttccataagggggctgctatggtctgaatgtttttgtccctccaaaatgtgtatgttgaaacctaacactcaaggtgatggtattagaaggtgggggtttgggggggtgattaggtcatgcgggctctgccttcagaaacaggatcagtgcccttataaaagcggctccagaaagcttccttgccctcccaccatgtaaggacacaccgaagatgccatttaacaggagtgggccctcaccagacaatgaatctgctgatgtcttgatcttggaattcccagcctccagaactataagcaataaattctgttgtttataaattacccagtctaaggtatttagctatagcggcccagactaagacaagggctgacagctgaaggctgtctaccagcagcactcctagcagctggggaactaagtccttcatttccaaaggggaatctaggcagcatatttacagcttttcactacagataagctcattatttcaaatagggactagcaggaaaaaattaaattgcccaaaatttagtgggatgctgaaatagattgtggtgtgtaaattggagtatagtgaggagagcaccttcaaaccagtatgtactacatgatattgtttttgttgcaatatttattatatacccaaacacacatatattacttttagaaacacacaccacatatatatctatgaatattttatatacacatagggaaggattgttgatgttatttatgctattttaaagatcgatgttttcatataattatgtattggttatatattatttcttgatataaggtaaaaaaaaaaagcaaaacaaactttaagtgatcactatgaaaagaatcccaatgctgcacatttaggtttatccaactcttcccattaaaatattaaatagtagaaataattgtgaataagaaagagcagattttgaaaaatggaaagaaatgcttaaagacatagcattgttgcccaaccatcattatttaaacatacagtgtttggctttgaccaaattgccttcaaacacttccttttggcccaaaatgttaggtcatatatactaccataaaattcatgatgcttaccatgcattaatttctagtatataccaggcattgtgctatgcatatcatattcaatatttctaatcctctcaaaagtggtacaagctaactggcgtttttcttgttttgaaagggagaaactcagagaggttaagtgacttgcccaaggcaatgccattgataagtgccagattctatcacaggtttattggcaacaaaccatatgtgcgcgtgcatgcgcgtgtgtgtgtgtgtgtgtgtgtgtgtacacatacacgaataacatatatggtataaatacgtggaaacataataaactgcattgagctgcgtttataattagtatttaggacatgtttggcaaataaaaacagtggagattgaaatggatttgcttaggaaaaatgatacattaaaataggctttattatgagtcttcaactattctgtgaaaatagatacccagggaagaaataatagagaatatgaatcttgagcaggcaactgagaacttgtcgaagagccaagataaaaatgtcagagaggagaatattttggcagctcagatgagcccccagagggtgggaggcaatgatctcaccgcagtctcgtatctgaaccccaggtttttgcatctccataaagtaatttcttacacccctcaataatgatcgggcttactctcaatctctcgctctctctctgtgtctctctcacgcacacaaacatgcagaacatttcttgcacatgcataactcataagacgattatgtaaataccagcctttttatttcataactaaattacaaggcctggttattgtttggactgtgaaaaaataattatgtgaataggtgcctcaagatgaaagacaaggcaagattgtgaaattattcatatgatagtaatagtatgcaaaaaataacacaatctttaaagatctttaacgacctagttataaaaccatgctttataacaaatataaccatgaggaaataaaaagaaaaatgtaataatatactccaagaataaagtcaaatgtattgttgaatgtaaggagttggttacacttccttatagtggaggttattttaaaatttgtggcttacgtggtgttatgaattgccctagatcaacactattatgcaaggccaactattaggttatttttggtagataaccacagcaaaactttagtataataggtaaaggttagctacactcccataccctcactctcaggtgttgtcatactccgtataaaaggttcaatcaagggagacatgagaatattccagaatctagaggcaggatgcagttaaccttagagaaggcatcagacaactagaatcttcggattcaatgtggaaacaaagcatagtttaggcattaaatcttgggcaccattccaaagaatacaggttccataacttactatatttttatacctagcaagctagagatgaggaattgctctcaaatattttaaccaaagcatgtatcttaagtaacactaatctcataagtgaaaactcatttctaatattcattttgctcattagcaaggcctctagtgttgactgtgataaaaaatagttcaaatgctggtagaacccaccccaggagactggcctttctgattaaattctaactctatccccacgtgaattcctgacttaagtaactgagttcctgcacatcagaatataagtatattatagatataaaaacatatgtaattaataaatattttaagtgagacacttctttcatctttatggcttaactatatcagacatttgattatttttagcggtctaactacaaaacaaaacacaaagcccacaactaaaaatttctttgtatatattgcaaagaggcaaccatttggtgtcaattcaatcatgagtgaaatgctattatacgagtacatctccctggcttgtatgggggtaatagggcatggaatttacagattcacaataactgagatattcacaataacaaagatatcaatatgtagcttttcccataactttgtgtaatgaaatcctcagtttgtgctgtgtaaaaagcttattgtttacttctcatgaaaatcatcttagtttttatctttatttaatagtctgtaatttgggggtaatacattcgttttgttgatactatgtgaagtggcaagcagaaaattctaacaggaatagataagcaagtatcctataaatcagagtcagtgtctctctctctctcttttaatgagtcagtctgtctctctctctttttccctgcctggctatctatctgtatttttcagttttgctttgcaaataagagaattgtgtgttgtaaaccaaccaacttaccattaattttctctgaattcaaaagcaattacaagcggactcttgagtttgtgctgcctggttgtctgcatataggccagatgtctagaataggatctttatttactatttttaccctcctaatttcatggtaactccaaggtagatgatatttgtaatcgtacactacttgtcagaaatctttctaataacactgctattttataaaaataaacattaattcagtataaaattttattttaaattgttaattcaagcaaatcagtgaggtaacttttacactgccgagcgtacgtgtgtgtggattagtacagccatgccatagacttcacttgtaatcttttctttatattttttatacacctgaaatgttcatcattgtgctgtagaaaacaatctcattgtgtttttaaaagctagagtgggtattgagaaggggaagaggatcatagaaaaagttggttaacatgctacttaacacttcaaatctttactcgatgtcatcatcagcaacattttaaatttatgcttctactagtttgcagttcttttcctttgattattcttatgatacaagcctttccacacaaaatttatgtacaggaattgtgtagaatttttctttggaaaatatggtgatttattacaatttgggcaacatcatcattttaaaaattcagaatttgatttttctcagaatcatcagaaagaataaagcatatatatggttcatgtcaggagaattagaacatgagaattaatatatctctgatcttttaaaatattttcatgtttgtgaatcagcagatttttcctagtttgagatttaaaaaatctagatataattaaaatctcactgatgtttcaccatcagatgattttatatttgtattttcttccacttcataacttgtatagagaagaatagaagaaagaaaaagggaggattgataatctttctctctcagttcttatagcacttcattttttaaacttattacttccttctgcctgctttgtttgtctacatgtttgtatttcatgatttcttagaaatccatctactgccattctgaaggtcatttacctgaaaatgatagaaagcagcatatattcaaacaactgcagagtaattgtctatatcagttatcattgttcattacttttctgttttaggattgaggggctgcctcgccacctccctcacacccccagcatattatcacaaagcctactgattcattcacatccctgggctgaatttgccacccactgtgtgttcctgttgttttgtgtatggaagtgaaaagatttaatttgatgttgttgaaaagacacagaggctaactttcaattttcatatgtagttcttccctctccctctgcaccacctcctttacttgttgagaaaattgccctctccatggtaacaatagaagaagctttcagattttagtagtagttgttgcagagaaaagaattcaaaaagtagatgaagtttaaaaatgaaaaagagagaggaagacagctgggaagaaggcttaatgtttatgagtgggtgtggaggggaagaactaagttgaatgaacaaagctgagctaaggggaagatggtttttctgcatcccagaaggcaataccctagcctttcctgcagccttcactccccaaaagataagagctttatctgaaattcttataggattcattcctgaagagcagcttgtcaccaaacagaaacactgtgatttcctcagggagtcacagtttattattatttttttaatgtaacgcttttgtgaactccagtttccacctcaattcaaatggtcttttggttacagggtgaaagagacccaacaatacacctttcccacttccggaggcctttggttaaaccatgtctgccacaaggacacaggagcctggtatgactggttgttttttgtttgcttttttgcctcctgtgctttctagattgtgagatactgtaactcttgtcgatgacacatagtaccgaacccacccgaagaagtatgtcagtatgtcacattgtgacaaacagcttctcatgctaagtaaatgcagaaccattgtgaaaggtttaataatgcccactcctcccccgccaaagatgtccatatcctaatcccaggaacctgtgaatatgttaccttacatggcaaaaggctttgtattaacagatgtggttaagttaaaaatcttgacacggagagatagcctgggttaccccagtgcgcccaatgtaatcacaagagtcctcctaagagagaaggaggtgatgatacaagcagagtaaaagagagattggaagatgctacactactggcattgaagatgaaggacagggccaagagccaagaaatgcaggcaggctctaaaagctggaaaaggcatggaaaagaatcctcccctacatcccttagagggaatgcaagctctgccaacacattgtttctagcttgtgagacccattttttggactttggacctccaaaattgtaagataataaatttgggttgttttaagccattaagtctgtaatcatttgttacaacagccacaggcagctaatacagccatgaacatttagtaatgactaactttgcacaattttaatacaagcttcttattaaggtttattttttcttaattacaaggaataaaagtggggtctgggggcaatgtcatggtccactccgttttagccatatgaatttgtatttccagcattagaacaaaaggtgacaaatctgaatgtatttgtgtgaaataataataaagcagaacaaaaagggaaaagtgtccagctggaaatgaagttagagaaagatgaggagaagcaagccaattgtgtagttttcccttctgctttttaaaatcatgatttgtttaacccactgaattctattttagaaacaggactgcaaggaagtgttgatggatttggtggcatgagaaccagagtcacagaggcaggaaagtaaggaataagtgttagaataggaagcagagttgcttgggaagagaccttatgacatgtggacagggctagacttaggagtcagaaagacctgagttcaaatgctatcctttagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccatttacacgatattgattcttcctacccatgagcacggaatgttcttccatttgtttgtgtcctcttttatttccttgagcagtggtttgtagttctccttgaagaggtccttcacatcgcttgtaagttggattcctaggtattttattctctttgaagcaattgtgaatgggagttcactcatgatttggctctctgtttgtctgtcgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttctcctaattgaataccctttatttccttctcctgcctgattgccctggccagaacttccaacactatgttgaataggagtggtgagagagggcatccctgtcttgtgccagttttcaaagggaatgcttctatagtacaaggctacagtaaccaaaacagcatggtactggtaccaaaacagacatatagatcaatggaacagaacagagccctcagaagtaacgccgcatatctaccactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaagggcaacaaaagccaaaattgacaaatgggatctaactaaactaaagagcttctgcacagcaaaagaaactaccatcagagtgaacaggcaacctacaacatgggagaaaattttcgcaacctgcttatctgacaaagagctaatatccagaatctacaatgaactccaacaaatttacaagaaaaaaacaaacaaccccatccaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgaggcactatttacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcattcataggtgggaattgaacaatgagaacacatggacacaggaaggggaacatcacactctggggactgttgtggggtggggggaggggggagggatggcattgggagatatacctaatgctagatgacgggttagtgggtgcagcgtgccagcatggcacatgtatacatatgtaactaacctgcacattgtgcacatgtaccctaaaacttaaagtataataataataataataataaaatctcaaaataattaaaaaaagaaacaaacaaatgctatcctgatcctaactggctggctgtctttggggaagttggtaatcttttctgtgcttatttcctcatgtgtaaaaaaatgaatatagtacccagctaggtagagttgttgttgggattaaatgatgactataaagcatctagcccagcttcggctacattatagctgcttacgaaattgtagttacgatgtaaaagagaaaaacactggaaaaggaggatatgggccattttattccaccttcaccaccttttagcttggtgaccttgggcaaattatgcttcattccgtgcttcattttccttgtctataaaagggtgtaagtacagaaccattgaggggtggtcattattaacctacctcaaatggtgtctgtaagttaatatatattgtgcttttcctatgtacaatatctagcacataattacaaatcaaatccatcccatgtgcaatatctagcacataggaaaagcacaataactagttattactcttgttgtagtaattgctacgctgtaggagtttgaattgtaaggcagtggagagtcactgacctttacgagaaagtgtagcagaacatttgagtagatagtaatggggaatattacataaatggatagatattaggggcagatattactattaaaatattacagcatggatatttattaaggccaaactggttaattagttgcatctctcaggttcctaatgttgcttaattttttaacctcccattttgtgctgccctttgtacgaatatttaatgctcccaacacctcttcagtagcacatgtactgtgagtttgttttgttattacttgtgtgtattagcattcctttgtgaaccaaaagcatggaattagctgttgcctctaggctacctagttttgtagtttggattgaagccttcacctcagtaacacctattctgtctactatcttacagaaaacttgtaaaattaagacagatcattaatatagcagaaagagacaaagggcagagaacattgagatactggatattggaaccacccaatagtgttgatttatttatgattatcagtttttgtctctgcctagcctcatgccactaaagtctctgaggcaacaaagaataagcaattttgctcaccttatacaaataaaacacagaaaaaggaatcactagagaaatggtactgcagcctttctgcagggattactgcttatttttaaattacttaaaaggtattgaaattattgttcataatgagaaacctgcctaataaaacagaaaattaaacttaacacttccctataatgtaaacagctcggttaggaacacaacattacagaaaccacttaagaattgattgtacttgttcttggagcagaactagaagctcaccgtttagaagctgtgcacatttccctatcaaacagtacataaagtttccatattcctcagaatcggcttcatttgtgccatgtgtttgcttggaactatgccacagaaagcagttctccccctcaagctgggctcctttcatgccgcagtgcaagtgtgtgatatactggcaccatgtgctaatgtagacccatttttatatgataagaattagtacggcctagggaatagacaagtatgtctaaaatcctccccatagaatatgtcccttcctttaaaagctgtcatactgtaagttccagctgagttaaaggccactgtgctcctatagggaaatatattctattgtaatttttacgttctccaataacagtctgttctttgtttactgaagagagctttcatgtcataaaatggtgttttttgacagagaagcagaatcattgttttattatagaaatttgctcttacaacagcaaaaataaatagctcatctcttaagctcctgatcaatgtctaacacctcctacccccagcaacacttcactgcaagtatattaacactctataatagcaattccactcacctaccaagaaatgatcttcacaaatgatttacagctaaaccagagcttaaacacatagcacccaatcaagggcagatttttatctttttcccagtcatataagttctgagaagaaatagattaatgttgatctcccagacaactgctgagaaaatgtacaaaggatgttgtttattttgaagaatgagacctagttgttaagcactttttccccttatatgtacgtccaaaggtaaccattacaccattttgatgcaaatttaggatatatatttattcatacctctcttctccattcggatgttgtctgtgtgagtgctcacagacacatgcacacatacacacatgcactcctgtttcacacttatttgtaaaactcacaaggatttccaagccattaatatagcattgtttaaggtgaacacatggttgttcaccatccatatgtatcttcactttgtagcactcagaatttggcaaaatcagaaggctgaaacctcatggattaaatatattctatataacatatgtcttaattgctgttactgtaaagaaacctggactagccatatttgactaatttctacctaaggtatttgaattcttataaatagattcattgctttaatcacacaagagtggtttatatgaatgtaattatctccactttatagctgaataaactgagcctgattctatccctatatgggaaacatgaattgaacagctgtgccaattattttgataattcaaatttcacatctaccatgtgaagacagcagaagagggttagggggcttgaattattctgattaactgtgttcatgagtgtaatcgcctctagataatcactcatttcttcacttcacttcccatctacaggtagtatcagcgaatggtaacatctcttgctttgcctcagtttattgatggctgccgttagaaataaaaagcatggttttgtttcagtacttaaatgaataatatcttcaaaatgtttttaaaacgtgaaaaggttgaatgcatttttaacaaatgttttgttagctttgacttttatttttgaacagatgagcacaataccccagtactcctttcctagaaataggagtactacctgaagacttatttcccaaagaaaaatatcaggtctagtgcagcaatacgtattaagggcattgaaaagttatattcacaaaatgtgacatcataacatatgttaatacttcttatcactgataataatccttgaagttgtatttccagagagatctcaatttcttctcacactctgaaagtctctgtttatcctttagagtaggaatgtaagaatttaacaaaacattctgaatgtttaccttttttctaaactgaaactacaatccctttttacccctatatagtaaaatataatattacaagtagaatcagcaaatttgtttaataattctttgggacagtttttacaagcaatggggttgaatttatgttccttgtgtgcagtggagttattatattcttcttaaaaagatgcatgaaggtaaattagaaatgttttacatgttttcatgacaggacatttaatcaaagaggagatacaagaggcttttcttgggttactgcaatttaattttccatttctttcttggaagggacattggatgcagttgtacgaggttaatatttctaacatgccacttttattgtggcattcttctgctctcaaacctctgatgatttcccatggccttcaacatgatgtccttatttgggcatctagtgttctgagccctcacattctggccccagcttcccttctcaacttgatcacagccatcgtaattctgctaactaattacacagctgcccttcccactctttctcaaccactctgctgtattctgacttctacactttagttttaaagctactccttgtcctgaaattccttctcccattaggtcattattaattgagttcatcctctaagttacagttcatgttgctgttcctctatggcaccttccctgaacctggtcccatataaaatcccatctctcagaatcccattagggtaggatatgtggtctgtagactattacgtttgtcatttacatattgtcttctattattgggtaactgcgtgtgcgagcatgcatgggctggcctgaaggtcacctccccaactgcattgaaagttcatcacaagttcaattatttcactagagagtctctttcatgtcatccatgaggcacattccctactgtgatgtgttatgcatacaattatttcaataaatattttctagctctttgattgaccaaagcttaattacctgtcaactctagcctcttgtatctggaatttctacagtctttggatagtatctttaggatgcaaaattaggaggagtatgtaccaggcaaactattacaaataatgccctcaaatagttacatttcactattcatgtcttgtaatttatcttctgctttggtattttagtacacttatgattcaatttgctgtatagattcctctgaatagggacaagagaattcgtcttgataagtggaagttcgaaggattccaaaatgatgttattcaaggtagaacaagaaattaatactgaaaaaattgaggagtaataatccccaaatatgtacatgcgtatctcgttttattgggtttcactttattgcactttgcagatatttcactttttgtaaattgaaagtttgtggcaaggctgcattgagcaagtccgtcgggcacaatttttccaacagcatgtgctcgctttacgtctctgtgtcacgttttggtaatttgctcaatatttcaaacattattattattattatatttgttatgatctgtgatcagtgacctttgatgttactattgtaattgttttgagatgtcatgaactgcactcatatgagatggcaaactttgtggggtgcagtggctcacacctgtaatcctaacactttgggaggccaaggcaggaggatcgtgttagcccagaagtttgagaccagtctgggaaacaaagtgagaccctgtctttaaaatatatatgtagaaaaattaactgggcatggtggcacatggctgtaaggagccctgccagctgcatgggaggctgacacaggaggatcacttgagcccaggaggtcaaggcggcagtaagccatgttcactccagtgccctccagccagaatgacagagcaagaccctgtgtggaaaaaaaaaaaaagacaaacattttttcaactttgattttagattcagggagtacatgtgtaggtttattaccttgatatattacatgatgccgaggtttggagtacaaatgatactgtcacccaggtactgagcatagtaaccgatagttagtttttcaacccttgtttccctccctccccactctagtagtcctccgtttctattgttgccatcattatgtccatgacaacgcactgtttagctccacatgagaacacgtggtatttggtattgtgtttctgcattaattcacttagaataatggcctccagctgcatccatgttgctgcaaaggacatgattttgttcttttttatggctgcatagtattccatggtgtatatgcaccgtattttctttctccagtctgccactgatgggcacctaggctgacttcatacctttgctattgtgaatagtgctgaaatgaggatgagaatacatgtggttttttagtaaagcaatttgttttatttgggctatatgcccagtaatgggatcactaggttgaacgatagttgtgttttaagtcctttgagaaatcttcaaactgtttcactgtggctgaactaatttgcattcccagcaacagtgtatcagagttccctcttctctacagcgtcagcagcatctgtcatttttttgactttttaataatagccagtatgaatggtgtgagacggtatctcgttgtggttttgatttgcatttctctgatgttgagtgatgtggagcattttttcatgtttgttggccacttgtatgtcttcttttgagtagtgtctgtttatgtcttttgcccattttttttgatggggttatttgtttttgacttgttgaattgtttaagttccctatagattctgaatattagacctttgtcagatgcatagtttgcaaatatattctcttattctgtagactgtctgtttactctgttgataaattctttcactgtgaagagctctttagtttaattaagttccacttgtcaatttttggttttgttataattgcttttgaggacttagttataaattctttcccaagtctgatgtccagagtggtgtttcctaggctttcttataggattcttataatttgagatctaatgtttaaacctttattccatcttgagttaatttttgtatatggtgtaaggagggggtccagttgcattcttctgcatatggctaaccagccatcccagcatcatgtcttaaatacagagtccttttcccattacttattttcataagatggcaaacttaatcaatcaatgttttgtgtgttctggctactccactgatcagccattccctcatctctcttcctctccttgggcctccctattccctgagacacaacaatattgaaattatgccagtcagtaaccctacaatgtcctctaagtgttcatgggaaaaaaaagagtcacatgtttgtcactttaaatcaaaagtcagaaatgattaagattggtgaggaaggcatgtcaaaagccaagacaggctgaaagccagacctcttgtgccagttggccaagttgtgaatgcaaaggaaacgttcttgaagaaaattaaaagtgctactctgttgaacacaggaataagaaagtggaacggccttatttttaatatggagaatgtcttagtggtctggatagaggatcaaaacagccacaccattatcttaagcaaaaggctaatctaaagcaaaggactaattctctgcaattctgtgaatgccgagagaggtgaggaagctgcagcagaaaagttggaagctagcagaagtatgttcatgagccttaatgaataagccctctctataacataaaagtgcaaggcagagcaacaagtgctgatggagaagctgcagcaaactatccagaagatcaaactaacatctaagttaataaaggtggcaatactaaacaacacattttcaatatagacgaaacagccttctattggaaaaggatgccatctaggactttcatagctagagagaagtcaatgcctggcttcaaaagttcaaaggacaggctgactgtcttgtgaggggctaatgcaactggtgactttcagttgaagccagtgctcgtttaccattccaaaaatcctagggcccttcaggttatgctagatctagtctgcctatgctctgtaaatcaaacaacaaagactagatgactgcacatctctttacagcatggtttgatgaacattttgagccctctgttgagacctacttctcaaaaaaatgtgtctttcaaaatattactgctctttgacaatgtccctggtcacccaagagccctgaggaatatgtccaaagagaatgattttattttcatacctgctaacacaacatccattctgcagtccttggatcaagaagtcacttcaactttcaagtcttattacttaaatcatacatttcataaaggtatagctgctatattgtggtgagtccactgatggatctggataaagtaaactgaaaacggaaagtcctcaccattccagatgccatgaagaaaattcatgattgaggggaggaggtcaaaatatcaacattatcaggagtttggaagtagttaattccaacactcatcaatgactttgagggtccaagacttcagtagaagaagtcactgcagatgtggtagaaatagcatgagaaccagaatgagaagtggagtcagaaggtgtgactgaatagctgtaatctcaaggtaaaacttcagcggatccagagttgctgcttatggatgagcaaagattgtggtttcatgagatgcactctactcttggtgatgatgctgtgaacattgttgaaatgacaacaaaggatttagaatattccataaacttagttgataaattagcatcagggtttgagaagattgactcaaattttgaaagaagttctactgagtaaaatgctatcaaacagcatcacatgctacaaagaaatcattggctataaaggagagccaatcgatgcagcaaacttcgttgttgtcttattttaagaaattgctacagccatcccgaccttcagcaaccgccaccctgatcaatcagcagccatcctcactgaggcaagagcctgtaccagcaaaaagattatgactccctgcaggctcagatgattgttaccattttttttaggagtaatgtattttcaaattaaggtatgtacattttttagatacaatgctattgcacacttgacagatgatagtagagtgtaaacataacatttaatgcactggggaaccaaaaatattcgtgtgcctcattttattgtgatatttactttattgcagcagtctggaaccaaacacacaatattccaaggcagtcctatatattgtttcatgtctctctttcttctaaaatgtgtgtaggagaaaaaattatatcacttatgttactgggccataatatcaaaagcctgcgaatctgatgcacatgataaaaactggtcttaaacctgtcttgattatcctttgttaatatgccaaatttatagaacaatagagtttcaagaaatgtgaacaatgtagaataactaaaagatctaacgttgaatagctaaaattatcaacgccctttatatcactttagaaatgcgtttgcaaatcattatcaacaaattgtagcataaaattctttttttttcttgactttgaaattgtatttcaagatccgcaatttacaccacattatttacttactggcttgtgaaagtgaaaggcattttcatttttggatgttaagggttttagtaaatgacaagtaaatcaatcctttaagttccgtgtggtataatagcttggaaaggaccatcttaatctttttttcaacacagggagataatttattttaaaaataacacactaatagtagattaatattattaccatttcaaagaagtcaccaaatttggtaggcttaagaggttttttttttttttttgagattactatgctctttttttattttatttattttatatttatttatttattttttagttttttaattttactttaagttctgggatacatgtgcagaacgtgcaggtttgttacctaggtatacatgtatcatggtggtttgctatactcatcaacccaacatccaggttttaagcccccaatgcattaggtatttgtcctaatgctctctgtccccttgcccctcaccccttgacaggccccggtgtgtgatgttcccctccctgtgtccatgtgttctcattgttcaattcccacttacgagtgagaacatgcagtgctaggcttaagagtttttttaactccccaaaatatcaacaaattgaaacattactacaaagaaatagagaaataaatttcactgactgtcttattgttttttaagtttgaatagctaataatgatttcttaaacagctatcatattttttatttttaaagctagccaaatgatcagtgatttttataatactgataaatactgcttagaaaaggaacatgtgttctagcaatttccacacatttctgattctaattacttgtttctttttgttttatttttatatttttaagttttgtgagtacctagcaggtgtatatatttatttggtacttgagatgttttgatacaggcatgcaatgtgtagtaagcacatcatgtaaaatggggtattcaacccctcaagcatttattctttatgttccaaacaatccaattatactcttttaattaatgtaaaatgtacaattaaatcattattggttatagtccccctgttgtgctatcaaatagtaggtcttactcattctttctaactaattttttgtacccagtaactatacctacaccacccccacctccccacgacccttcccatcctcaggtaaccatccttctactctctatgtccatgagttcaattgttttgaattttaaatcccacaaataagtgagaacatgcaatgtttgtctttctgtgtctgatttatttcacctagcatactgacctccatttccaacaatgttgttgcagatgacagaatctcattcttttttgtggctgagtagtattccattgtgcataggtaccacatgttctttgtccattcatctactgatggacacttaggttgcttccaaatcttggctattgtgaatagcgctgcaataaacatgggagtgcagatatctcttcaatatactgatttattttcttttgggtatatacccagcagcgggaatgctatattatatggtagctctatttttagttttttgaggaacctccaaacggttctccatagtggttgtgctaatttacatttccaccaacagtatacaagggttcctttttcttcacatacttgtcaacattggttattgcctgtcttttggatataagccattttaacgggagtgaggtaatatgtcattgtaattttgattttcatttctctggttatcaatgattcagtgatgttgagcaccttttcatatgcttgtttgccatttgtatgtattcttgatctgccacaagtctctaattacttgtttcttgtaccactgtttcccttcattgtagtcagtgatttggtcaatcaacactttttacgtatgggtatctgttaactgtatttctaggaatggaccaagaattgagaaatttatcccaaccagaaagaacaaaatctatggaggcacaggattactgaaagctttgctcctatagcctcagtttttttctgcaagttcgctgcttcccagttgtccttgtgataaaattcaaaacctcaaactgatttttaaaaagccaactatatactgcttctactatgtctacctaaacttatttgccattatttgtaaagaattccaggctctaaccagcccatttgaggctttattttacgttcatgcctttgttcatgtctgtctttcccttataatgctcttctcattctctagccaaatctgccaaagttcagctgtagtgccatacttgatatgaagtctttgctgagaattcccatatgtggtcatttccttcactgatttgtttcaatagttgttgccattattattattttttttatactgttgctggatactttcgcagatccaatctctaacctgttgttctaccctaggaggttgaccaatatggcagtagcattgggcttgcttgtctattggcttggtccttgtgttgggaggcatcagcagatcaatggatgagaggagagtgagtcgagggatggctaggttcctttactcacagccccagctcctgtcaagaggtcttgtccctgcagccacttctcagattctactaactataccctccccttagcctttcaggccttgaggaggaaagcctcctcatcccactttgaatgaactatttattgcaagaaccatgactgattcagaatataatctgtccttgaatgaaatagttaatttccccttttgtattctcgtttcatatccctgtccctttatccattcctatattatatcatactatcatatagctaccttatattatactatgacatgagtaccttgtaagtatatcatgctatattatagttcttaagtgtgtgggctttggggccaacttacctatgttagaagttctgccacttattaccatgtgatcctagacaaattgtttaacttctttttcattcattttctttactagtaaaataggggcaatattagtacccacctcacagagtaatatgataattacattgactgatagtttttatttaaaacttttattgttcttactatgaaatgggaaatgttctaaacaccttacaaatattaactctattaattctcataatgaatctgagaggtagagactcagtatctccatttcacagtgctggaaatgatacagacagcatttaagtaacatactgaaaatagtaaaccgaataggtggcagccagtatgcaaattgggaaagcctgactccagagttcattcttttaactagtatgctgtgatagactcttttggcatatggtatgcactcaataaacaactattgttgttgtcgttagcattacttcccattgtattattacacaaaaaataattgtttatgagtatttgtttgctagattataagttccttgaaaaaagaagacaagttttatttgtctatgtgtactagctgagtgcttggcaaatagttgcagtttagtaaatgtttctaaaacaaattattagttgtttcttatgtatttcccaagtctatcctagccttggaaacagctaacacttagctaaacctagaaatgtcatttgagatttcagcagccatcattgttgctgaagccacaggttctcctttttatctccaatttcttcctcagatgattcaccactttctttgtcgtttccctacttcatttttcctatagtgacttttgttctccaataaccattgatagtgatgacagtcccaccttggaaccacttctaactgtcctgttcagcttttcctgaggccagatttcccccaaaatacattttttagcttcataactgctccttccagaaatttgaaacgcattctcaggaattaagcaagaggcatttgattgacgtcatttaatttgtgtttaaatgtgttcttcccatcaacgattaaccagtgcttcagccaagatacataacttttattctccactaaccttagggttgaggtcacaatcaggtacgtaatctgtagagcccagtgaaaaatgaaaacgcagggcccttggttaaaaaaaaattaagaatttcaagatggcaacagtagagcatgaaaccaagtatgaatcccttctaatgcagatccttgtgtaactaactgcacaagttatacgttcaagaagctggtcctggttgaggtctttgtctacctagggcacttctcactcagagaggtggaataatcttaactttctgtcttccgtcatctgaaaacttgccccaaagttccttttgccatctcttgcagcaaacctagtggttgttatctgttaaggattcctggtggcttgctttagtttcctacagttcttgagctgcatgtgttgaatggaactccaccattaccatgtaacacatctgaatactcttattttcctccagttaaattctgcgctccttggaaataatggtcatgcaccctaccttagtgatttctaaatagaggtagtatgtaaaaatacatatttacttgaattgcatcttaagaggccagcccatgggaggcatgaagaaacctatgttactaattaatattcaataattgacagttacacattcaggtagtagtgtcatggaaccatcacgttacatggaactgaagagctgatgagaggtttagggtctaggaggacaaaagtgagtgtattagtcagggcctgaggttatatgtacccagacaggataaaatgggacaatattttattagtggaaatatctatgtgaaagaaaagaaggaggaagccaaggaaggtgcaagagatgttagatcaagatgcaattctgactctgcaaggaagagagagggagagaaggctaggcagaagcatcccagtgtgcggtctagtggaaggaaattttggcaaagctgttgggaagtcattgaggcagagccaggcaaagaagtcccatgtctcccaaggaaggctctctgccttagtattcccaccacacccaatcattgggtgaggagaagtctgtgagaagcttggctttggtgcagtgcaatcatggatttcaaaatgcagtaacaggagtcctcagtcagttaagacccaataatagaaggcctgcatattctcatggtggccacttgggtatgaggagcagtggtgtttaaaactgttttgtataatttaaataaagaaaagctgaggactacttaagcttgattccttcagaagacagtctttggcctttatatttcatgtgatatctttgccatatgctctgataactctccatgtttcccctaccataatacctcaggttgttgcaattgcttttttattgcctgtcatcactactcgtttgttttctctttgagaacaggaattattttctccttcactgctacagcccctgcacctagctcaatgagtgacacaacagaagcacttaaaaaattgctataactcaaatttgggggatattctacaaaatacctggcctctgttggtcaaaactgtaagtgttataaagttcaaagaaaggcaaataactatttcaacttaaaaaagactaaggagatacgacaactaaaagcaatgcgtgagtctggaccagaccaggaaataaaaatatagctataaagttcattaatggggtaattgtcatactctgaatatagagtatggataagattatggtactaaagccacgctaaatttcctgactttgaaactgagctgaggttatttaagagaatgtctttgctattaagaaataaaacctaaagtatttaagggtaaaggggcatgatatctgcaaattattctcaaatgattcagaaaaaaaatatatatatataaaacattacatatacagttatatatctatacacacagagagaatgataaaatgataaataattaaaaataatgtggcaaaatgttaacaaatggtgaatccgggcaagggttacctgggagttctttatcttgcaaatattctgcaagcttgaaattatataaaaataaaatgcatcttataaagtatttattcagtgaataaagaacaaaaaaggctaactgcagttggaagatatttatgaagttggttatgaagattcttaagaagttaccgatggaggtgctagtagaacattcaaaaaagaagtagggaaggttgaccaagtaggaaaatatcaatatccaagccagtataaaatggaaatgagaagtgaggaagtaagtggaagacaatgaggatggttttcgatttggccactctatttggagaggcagccgaatgcaagaatagaagccagaagaagatgctcagtgagatggttgaaagctagatagattacagcatcctcaccagtaaaaccctttcggtaactagaaaggctacaatttagtaccttcctgacttctatgcttattttcttcaatacataaaatggttccgtaaactcttttaccttctgaattctttatattaattttttgaagttgtaaataaaatagcatcagttctacattgttacatttcagcttaattcatattcatttactgaaaatgggaacatttgaaaaatcatcatgggcatttatgctatgtagattgttgatttttatagaaaaatataaaaatatgaccagtttgattttcaaagtcttttcttagacatgtaaatactaagcattcaactcaacatatagagtttttatttgagtattatttaggtggaattctattttaatgaatacaataaaaaattgtaattttgtctaaaagcctaaaatgccctagttataatatgtatgatttcactgtttaacttcctatttcatagggttgctatttataaccacttcactcaactctggggggacttagtgagattaaagacttctgattcactttgtatttgaagaattttttttcctccatctttgctcagctagtggaatccatgatgaattctcatctccaaggggtaagcagtttttagtaaagcccagtagctgacttatgactccttagaaatagcattgattccttccttctcctgtgttttgtttcctctagaatgatagaatccatgtagacacgatccattatcatgcttaggtactggtaagcatgtaatgattttagttttgttcgctttaagttatttgtgtcacaaatatctgggatcatatcagagaaataaataagcacaattagcattctacttgtttgttatgactaaagctaggttgaggaaacagaaaaggaccagaggtcatatgaggatgaagataatactaggaacagcatgtttgggagagtaacatctggtaggggtagcagattgggggcagagaacagaattttatagatggatattttggaggcaagtagtttgagtaatgattagatctaaggtgttttctcatctgtgggtggctcgaaggaatagaggtgaaggtcagtttatttgagaagttctggaattataaaactaagttgaagtcaaagaaagtatagtagcaaataaatagaatacccttaaaaggaaaccaaatgaaaaataatcgttactctcaccatatgcttgtgttcttattagcaagaaattcttttaaccactgtttttataatatcttaatgaaaaaatactgaagcgtatgccatattaaatccctctctttatttctagaaagggaatcaaaggagaaaattcccattctgctatactaaaagaccactaagtaaagagcctattagtgtatgataaatcccatagcaatatacattatcattttacagcttctttgttgaaatgaatgtttgtatgtgttgaccatagagtgggataaaaagttgaaattttgttttgaaatattttagaaatgcatagttgtactgcagttgtgaacctccttagatttttaaggaggctgcttcaaaggatctcattaataatcttctcaggtgcttacaaagcatgtgtctgtcagcagaattagagaatcacccaactagagaacaggtttcacaataccctgagacctattttgttcattagagaggaaaatggcttgttttgagtctaagttgacatgcttgctaatttcagcaataaaagctgttcattgtggtcaggtttaatttagagcctggtaaggttcagattaaagttgatcaacttacttttacaacatacttcttaaatgaactttgaaatcttaaaagaaggaaaaaagtatagcaaacagtgaataatgtatctaaaactgagaagcaaaaaaaatctggttatgtgagagtgaattaaaagaagaacaacccaataaagataatctttgttatataaaaatttccaagtatcgaaaagcacgatttttcatgtgagttacacactataccgaatatatttgtccactgccacatgcatagtccctagaatagtgcctagtgctgaaaaatatttattaaaatgaatggatgagtaaatgaatttatgtattttgccagccctgtgtatttaaagttctctgttaactttgaggtgaaaatttgacttcatctgaggtttctgggtaagtccgttttaaaaattctattgaacatattcaaacattttagggtaggcaattccaaagcaacctttcagcttcccatgtcacagatgaccagagtttcacattctaacactggaaaacatcttatttcataaaatctacctgctactatatggttcctactttaaaatttgttcagtactctccagctgacttatgccacttacttcaatagctgtctttggcaatttgttccatatttcaaacactctgttgtgtaaagaaaccataaaagttagaaacctgaaaattggattttttttctgagcaatcacagcttacaaatgtggaaaatttgttaaaagttagcccctccaatttttcaatacagagaggagaaagtgcctaaagtagatgtacaatgtttggaaaagttttttgcattattttactattaccaaaagcaattgagtttaaatcacaaagcctgtctccctacctcttcacagaagaaacactacagaatgatcaaaatttggcctttccaaaaccaaaattcgttagaaaatcagcaggagtcaaagtacagagtaaataactaagtttcatataagtttcagatacattactatctaccactttcatctcttcatcttcattggcctcatgtggtagaacatcatatttaaaattatacaaacttgctggcttgtttactagtgtggttattataagaaaaaaatgagaaaatatagataaaacatctgtcacatattgcttataaactaacagtaaatattacttgtattttccccaattaaaataaaatttactgagttttagaaccagagctagtcagatgcctttttttcataaatttcttcataaatacctctgagattgtggtccttaaatctagagagactaagatgacagagaaaatagacactgaagaaagggaagaatatcttaatgatttacattactacctataaattaaaaattgttaactttattatatttgtatttttatttaaaatagtgctatattaaagtcatttataatacaggggaataggaatactaacctgtaatctgatgctctccaaacttgcctaaatcataaaagttaattagataatttatttaaaatgcaagatttgcagccctttccactacatattcattagttctggagggaggcaaaaaggtttggtgattcttacggacaggcagcttaggagaaaagctgatttagctcgtctacttcaccttttcatttgacaggtgagaaatctcaggggtacaatgaagttaaataagtaatatctcttaaatcggttctgtgctttttctgtttttaaaataaatataccttaattttgacgtcacacagaatgatattataagtataaatagttatctatcttttaaatacattgtcgtaattcagaataacatttcttactcaaggcattcagacagtggtttaagtaatccgaggtactccggaatgtctccatttgagcctttaaatgaagaaaatctatagtcaagattttcatttgaaatatttttgatatctaagaatgaaacatatttcctgttaaattgttttctataaacccttatacagtaacatcttttttatttctaaaagtgttttggctggtctcacaattgtactttactttgtattatgtaaaaggaatacacaacgctgaagaaccctgatactaagggatatttgttcttacaggcaacaatgcaggatttggaacagaggcgtccccagttggaagaactcattaccgctgcccaaaatttgaaaaacaagaccagcaatcaagaggctagaacaatcattacggatcgaagtaagttttttaacaagcatgggacacacaaagcaagatgcatgacaagtttcaataaaaacttaagttcatatatccccctcacatttataaaaataatgtgaaataattgtaaatgataacaattgtgctgagattttcagtccataatgttaccttttaataaatgaatgtaattccattgaatagaagaaatacatttttaaatcaattcagggcttatatagttgcaaagcatgcattgatgggtgtggtgaccacagtgtggcagaacatttgtggcagaacatttgttctttagttgtcatctgggctggcatccatggagatgccagtctctccctcatatccttggctgttggtccaagcaggcagtggcttcttcctgggccatctttcattcccatgtgcagtgactttcagatctggatatctctccgctactttgatgcccccattttgtaatatcaaaaatcatcgtactgtaccttatgccgtagtagggtgggcaggaactttggtaagacccatctgactagacgctgtgcatattcttttcttctgacatacactcctatccatttaatggggagagtgattcgcagtgattgtgtgttgtgtcagtgagtttccatggggtcaggaagagtgacagacgaaggagtaggggaaactcgccacccggtttccctcagagattctcctcagaaatgaggtccaagtcagctctgctttcaggttctctcagatctctctcggtttcttcacttctctctaccttccttccctccagggacacacactggtattgaattttcttgcttcctctgcaatatcccctcattttccttcccacaacccgaagaatcctttgtagtgcaggaaggaggaaaacctttcagccatctttttttttctctttgaaatcttttgtcttttaccaggcttagacttttcaaactcggaaaccatgagagtctatatcttcataatttatattctgctatgttaacccttccctaaggaaatgactagttgtcaatatgttggggaaagtgaaagagtaaccagagtaaaaggttaatattttaaaatattattagtcatacttccacatattgggtaagtacttattgataatagctagtatttattcagtacctcataagcattagatggtgtgtgcacatgtgtgtgtttctgtgtgtttctgtgtgtgtgtacaaaatctttacagaatcttgtgagctatattttataatccccattttatagacgagaaaacaggttccaagaacagttactcggccgggcgcggtggctcacgcctgtaatcccagcacttggggaggccgaggcgggcggatcacgaggtcaggagatcgagaccatcctggctaacacggtgaaaccccgtctctactaaaaatacaaaaaaaaattagccgggcgtggtggcgggcgcctgtagtcccagctacttgggaggctgaggcaggagaatggcgtgaacccgggaggcggagcttgcagtgagccgagattgcgccactgcactccagcctgggcgacagagcgagactgcgtcgtttacaaacaagcaaagaacagagcttggaatttgtaaatgtctctttctgacttgaaaatctgcgctctttctagtatgtttaccatttcccatcttgttttgttgcttttgttaatgaccttaatcattgtactaagactaaatacttcttttgtctgaaattatgtatgttttgattcacttcctaaagacatgtcttctttcagttgtagtgattgctaattaaaataggctgttcttggttttgaaagtttaactctttattgttgcttaaacaatgaatgtggatgtatgctaatgtattatttcagtaacactagccactataacaggtaatctcccaaatcttggaggcttactacagcagaaatttacttcttattttagtgcagtccaaaataagcagccctctatgaagtcattcaggaacccaagctccttccatcttttgtgtccagagcataagactcatatgcatttaatgggcagatgaagaatgagtattactcatgaaaatttgtcatgagccacgcctggaaatggtgtgtgttaattttgttcatattctgttggatggatcttgtcacatggtcacacctaactgcgagggaattagggaaatagtgtacactgttgagcctaggaagaggaacagatttggtaagatagccatacaattgatttagcagagcattcctccaccatactggaaccttgagggttctccaacaagttgcaacacactgacccaaaagagtgaatcttagtgagtgatttactcaatatgagactgaattcccattacacaggtaagtgatcagtttcttgcctgagaaatatggaaatttggcagtgaggtttatgcaaatctgaacatactatacagagagtcatttgttattttactaatgaaaaatcacttcaattttttccctaagaggaagacaatatgaatgtattatacagtatttgttcaacattgtctgaacattttccattatcccctgcatttttttttcatattgcattgactttttcatgatagagattaaaattgaatgaccggagggcaagtttgtatctctctgccaatattcagtgatttgaatagttcttcttttctaagcttttgtcttttaggaatgaatacctttatgaatatttgcagcctagtggaaaggctgtaatccaaatggtccaagaaagcattttcttaaaagcaagtgtctgtcgagatgtgtcatagcgcttattaagagtctaagctggaatcttagttccaaatatgcctggagcctctaaatggtaccaggataattctgacaagatatgtttatctaaacaatgtcatttgcagccctgctacacttcagtttatctctccctttgaaatctataaaatgggatggaaattcaatactcataaacttttcgatcgtgttcaaaatagaatttttcttagtaaagatttggttttcaggaaaaggacagaaataaaatacttgctcataaaattgtattttctcatttgatgattttggtcttcctttttattgccatgaaacttctagaaatgctcaaaaagaaatcagctaaataaagaaaaaatagttaatatatgtatgtaatactatattgaaacatttttctttctctggtaaatcccatttcataactttgaacagttgggaaaatctatacatagttattgcagtctatcaagagaaaagttcagtacaaagctatttatgtctactagaaatattcatgttaaacttcaagtaattgggtgtgcaagccaccaccatgttttactatatgaaactattaccgtggtatctgttgtattcaggtaattatattgatggaaatcatgcagtaataatctaggtaagagagtaaattttgtctaaatcagatcaaatgaaaaattctccctctttctaatattcgaattgctcatttttctttaactctttggtgtctgaatttgtcaatcattcctggccattttcttctgcaaaagggctgggtcaggggaccaaaagcagataagattagaagaatttaaattttcttccttggaggcgtctgaattacatgaaactcttgttcgtgtctgttaatactgcaaggcataataccataataccttgcatagcagtgaagaggatttggaaagataaaactgcttccttttatcattctgtttatttcacaaacaatattggtgaatgtcgttcctgtaacatttggatttaagagccttgtttctgtagcttctccctccgtaacccccaccactaccatttcggggctatacagcaatagcatgcattactttaaaaggcaggctgcctagactggccacttgttagctttgtggccttgagcaaatgactaatctcagtaaactatctgctcttagtttccttctctgtaaaataggctcacttataactatctcatgggttgggaggattagatgaaataattaatgtagagcccttagatcagggccatagtaaaagctgaatgaatgttagcatttgttattttaattataatctattggggtgctttgaaggcttaatgcaaaatacttaatgagctttttggtagctgtttagttatttcgccccccaccaccaccccaaaaggagagatttaaaagaccgacaggagaaggttgcttggaaaagatggaataagatctataaatagaattaaacaaatattcaggaaagccttttgtgggaaatactgcaaaatttttattatctataaatttaataggtagataaaattactactcccattttagagacagaaaaccgagactcggagagctaacgtaacttgtctagggtcttaggaagatgacaagtgaggaagtagaattcaagcccacgtctatatgattttaaagcccgaggcacatcaaatggaaaaggctggttagtcagaaaaataggaaggtatatttatctgacaacttaaaatattaggactaacctcaggtaattatagtctggatatacatttttgctgctcctgtttatacttttgacttctgtgtatttgagtgtctaatcaaaggattgtcttttacatgtgttggagatgtacagactagtggaccccaatgatctattagctgtgtaaccttagccaagttaattctctttcctaaactgtggttctctcatctgtcatgtggggctaataatagtacttatgctggtagggtgattaagaaagtaaaataattggtgtttctaaagtaaatatgtggcacatattagatgctcattaaatggtacatattgttatggtgagatggatttggtacagagagaactggagatgggagaatatgaagggtgtataatgtggccttttattagctaaaccaagggaaggacttctgaaacagaattccaagttttaagagggagtcgtttattttggaattattttttcagctaaggatttttcaacccagtccagaattcttagagaaatttagtgatagcttataaattttaagaaaaggaattcacattatattgcataaagaactggtatacagggccatagaaggggagaatgttcttctgtatgagaataaaaaaaaacatctctcacacgatttttgaattaactgacagttttatagcagctttgtcaacccatcattcattgctgcaaccaaatctatgaaatccttcatggcgaaataaaaaggctctgttgttctccacatttgtatgaaatctctgttgctaatgaaatgccagccagtatcttcctctcaggtattgtctattagatggttgcttattttagaagaagtggagtcaaccatataaatttccttcttttgacatctagcacctgctgtcaacctgttatagctacaagcagctctcaaaattcacatccactaggatgccgctggcaaccaaagagttcagttcagttcagcgaacgtttgaatgcctactctgtgctatctaatatcagagatggtagaggggatacaggaaaaaagtaagattcagcctttgtctttaaagagctcacaatcaaatgtgggtatttggacaagtatatttaggcaaggcagtttaggataggtgcttcagtagagcagtattacaaaatgttgagagaaaactagaggaggagttttaaatgagggcttagtggaatgcttccaggaggaggctgaatttgacctggtcatgaataagactttgaaaagcagaaggaagctggagagggaagggtatttcaggaattgatgacaggagaatacataattagacctgttaacagtggggtggaagacgaatatcagcatgggagtgtgtgtgtgtgtgtgtgtgtgtgtgtgtgtgtgtgtgtgtgtgttgtggaggataagggagtaaatgaagtcagtaagaccagttagaaggcaagagagcccaagctggagcagtgaccatggagtaaaaagaaagaagtgaaattgagacataaggtggagctagaattaacaggattttgacattgattgcatatataaaactgtcaatctaagagaaggcctgcctctaagagttggagattgaattctttggaagattaatgtcataaccagagacaaactcaggataaggagttgattatgggagacaaagtaatgtgcttaacatgaagctagatgaccatactgagattttaaagaaatggttgaaaacatagagattgcaggagtgatgttacttttggacaagaattcaaaagttacctggaatgtctgagcttgcacagagagagggtacctggtgcaaagaaaagtgaacctaggaaaaagcctagaagttggtttacatttaaggaatttgagaagaggtagcaccacccaccccccacacaacccccaaccctgccaacttacaatatagaagcatttagacacacactgaataataattttttttttgagacagagtcctgctccattgcccaggctggagtgcagtggtgccatctttgctcactgcaactccgcctcccagattcaagctattctcttgcctcagcctaccgagtagctggcattacaggctcccaccatcatgcccagctaatttttttgtatttttagtagggacggggtttcgtcatgttggccaggctggtctcaaactcttgacttcaggtgatccacccgcctcggcctcccaaagtgctgggattacagacctgagccaccgcgcccagcctaaataatgaatttatagatgctacactgtatggtttcctttttctgctgctgtacaaccattcaagtaacataagtttcatcctggttcttaatgataccatgaataaagtatagaaactctttagctgaggattaaagattgttgtgtttaggtagaccaggtttctgatgcagccctcagtataccagggaaattagccattactgtttgccttgtaggtctaatgaaccctttagctttttattttgtatatgtctaagttactctacaaattcttatggaagtataaagagatagtgaaagacaatcttatgagaaattttaataagaattgaaatacaggctgggcacagtggctcactcctgtaattccagcactttgggaggctgaagcgatggatcacctgaggtcaggagttcgaaaccagcctggctaacatggtgaagccccatctctactaaaaatacaaaaaaattagccaggcatggtggcgggcacctgtaatcccagctactcgggaggctgaggcaggagaattgcttgaacccgggaggcggaggttgcactgagccgagatcacgccattgcactctaacctgggcaacaagagtgaaactccatcgtaaataaataaataaataaataataaaaaagaaatacaacttactttttgtatcaaataaattttggtgcacaaacatcataaatgacataatatctgtcacacatcctttagcaaaacaggattgttaaaattcttacagctaatattatgtggtgaagttcttcctgttgaataattaagtggattaaaatatcatatttcctttctgtcattagaaatatattgtgcattaatcagtccttgggcctgagaacatttatctaggttttcatcatctgaaaactcacagtccaatatttcacctgtattatcaattcaccattatcattagagtttagaatgctgctgtctctttccatctatcttctgttgtatctaataattaggagatatatatatatatatatatatatatagagagagagagagagagagagagagagagagagtgagagagagagagagattggtaataatactaatatatataataatattatatatatacacacatacagagagagagagagagagagagagagagattgattttaagccattaactcatatgattgtgggagctgaaaagtcaaaaatctgtaaaatccaaaagcctggcaggatggagaccaagggaagagttgatgttgcaatcttgagtccaaaggtaatccgatagcagaattccttccttttctggggacttcagtcttttctcttaaggacttcaaaattgattggagaaggcccacccacattgtggagggtaatctgctttactcaaagtctgctgattgaaatgttaatcacatctaaaaaataccttcacagcaacatctagattggtgtttgaccaaacaactgggaaccatagcccagccaagttaacacataaaatttaccatcatcagccatcatcatgaggttcataatgtcatgtgtttcttcacatataaatctcgtggttcttttatttttttagtagtacctagttaataaggtacctggaaatatacgttaaataatagaaatggtctttaatatcttaatgaatttcagagttctatcagagtaattgtaacttgtatataaaaactgatatataaaaaacaagtatgttttttcttcctatacgttgtgttaaattaatactaattacctatcatgaaatgaatgttttccatttttcataaatgtatttcatttttaaattaagaggattaatatcaaaacatatttgaataggatttaaaatccaaattacctgttgcgattatatttaattataaatctttcaagtgagtttataataggaaaaatattttttattaaagtgatgtaccataattatgaacataaatagtgttttctactaattgtttttgtcttcattatgtttctttttaaggggaaagatctgggttaacaaatgttttattcatccaccttgaaaattaaacataataaacaaaactattaaataaataaaccaattaaagaaaatagtttttcttccttttttgtgataaagatgattatgagtaaatatattaaagaattttatactcagacaaagtgagctaataagacaaatacaaacagagatgagcccagaaagagatactctacatgtttataggctagcatttttatcttatgacctacagggtcattgtaactaaagtcttgaatttctgttatattttggtacctgtgggcataaataggaatattactccctgatggcatcatgcattttagataaaactaagccaagggttaaacacgtgccatggactgttcctaaaaaatgctctcagctctcaagttatagaaaattgtagggattattattttgtacctactacttctttctttaccaaaatttacttatacatgatttgaaaattgcttgccacctgtctttattctgttgtacttgtcttaagtaaaacatttataaagtaagtaggaaggattaatagattgtgacctttctacatgaaaaggggaaagccgagcttgttctacttttgtcaggaaagagtttgaatagttacctgttactgtaaaacaatcaccccaaacttagtgtcctaaagtagcaataatcatttattatcactcataggttctgtaggtcaggattcatgcattgcttggttgaggggttctgtctcacgatcactcatgatgttgcactcagatgtcaattaggctgcagtcatatgatggcttgactggggctgaaggattcactttcacagtgagttacttgtatagcttgtgagttggtgctgtctagttggtttccctctaaacgagttcctccatgggactacttgagtgttcttatgatgtggtggctggcttaccccaggacaagcaacctatgagttttgccctgagttttctgaaacatgatcccatgttgctttgaatatccccattagacactcccacaaatgtcaatcatactctttgccctaaaagttgcagactacttgtacatgtcctttatcctacatgtgtacaggaaacacgtgcagaataacatgtgtttttgtttcttgaaagaaacaagaacccaccaaaactttatagctccgggacatgatgataattatctcaggtccactcagcctggctccacatggaaaatatgggtattgtaaagaaagcttttgaattttggaggcctaacaaaaagacctaggaagctaatagttggttatgagataattataacaatggtgatgaaagcaattgcgattattacttttatgttagtgagataaatacataagaatgtccttctttaatttcattccttaatttccttaatccccattcttgatttctggattagaggaaagctatactatctacctgattacacaaaaagactggactgaggggtaaccattaggactcttgttagttgaaggtaataaactatattacttcagtggctaaaacaaacaggagcttttttctcatataaaactagaagtcaggaaacaaatggttgctgatgttggtttatccgtttgacaggttctacctttatcctggagattctttggcctttatttctttagtaatatagtagtaacagcactgaatctaaaataagagcacttggtccaagcactggctctgcccccttagtgacagtgggacccatggcaaattatttaatctctccaacagttaattttctcatctgtaaaactgggatcctgataacttccatactagtttggtgttaggattcaatgaaatgacgcatggaaaagtccttttcaaatggctactcactatacaaatattaatgtcttagtaagctcaggctgctataaaataatgccatagactgggtggcttaaacaacaggcagttgtttttcacggttctggaggttgagaagtacaagatcatggtgctgacagatgtggttcctggtgagaaccttcttcttgctgtatcctcgtatgttggggagagaggtggtgcagagaggtactctagtctctcttcttgctcttcttaaaaggacactaatccaattatggaggcctcaacctatgacctcatctaacccttattatttctcaaaggccccacctccaaatatccattgggggttagcacttcaacatacaaattttagccggcgggggggatgccagcattcagtccataacaatcaactatcctcattattgagagttccactaggccttctcaagggttgacaatgatagtgccctgctagctataagagtaaaaaaattttcacatctagaaaatgggtgcacgaatattggtaactgttctaatgtctatgcacagaatttttagaacttgctcgagaaatttgtctttcctgacagtgttgcttctcttaaattccagtcgagggccttgaaaaaaataggttttccatcaagattctctgaatgaataaatgaaatgctctgatattttctttcaatattaagataaagcaaaatgtatacagaattttctattttcagtgtttccaattactgcatggtttggcttattaccatctctaagtctaaccctgggtcataggagtaaagccattgggggtcccctacaaaggatacaaggcagtggtagatacaataagcctgacaattggagtcagatttttctctttcatacaggaaccatggaactgttgccctgggccacagctggctctcagaaaaacgtagaactggtcgaggaaaggaaaggcagggagtccttgattcacttgttatcagaaaattgtctgttcaaacaacagaatgtttgaaaagataaaatcaagtctcaaatgcacagaataagaatgaggggaaaacacctttctctgtaattaaacagaaaagtgtgccatgaagtgataaaacccagtcaacctgaaaatgtgaacatcaagtgtaattgtgcagaacgataaggtaatatgaacagcacaggaatatataggctcacgttggcattttaaagcaatggcactttacctgttcctcatgaaggatttggtttagtctaatcccttgtaggagccactaagaggagaaggcacagtccttttgggatgtaaaatggggaattctttctatgattacaagaatttgtaaattgctcagagttttaggacagcaggttatgtgtctctcaatgttgggtaccatgccaaacgtactttaagagacatagcaataaatagaatgggattcatttttttcttaatgtctggcagggcaaccaaaatgcccacgtttcccttcagtagcttggtattttggtaactaaaaacatgttccagggaactccagaatatgaaacatttcagacaatttgaaactgtcaaaattttcacttctttatgggacaaataaaatctaactttattcagattttaaagtatctcataaaagagtaatactttagatttgtgctgtgctttatacgaattggatgaggaactcttatacatatataagtggattttattttcacaacagtccctatggtagatattgtccttattaagtaaatgagagaaccaactatcaaagatattaatattttgcataagatcacacagatagcggaaccaggatttaatccaactcctctgattctaaaaataggtgttagatgggtattctttccccaaacctatgctgaaaggaggctacatttggagtcagttattgaaagtttaaatatatgtgtatatatatatatatatgtgtgtgtgtgtgtgtgtgtgtgtgtgtgtattcttatatactcatgcatgtagatagttataaagtacatgcttatatgtcaattttatatatacgactgatatataaactatcaatttgtgatagtttatttcaattaagttcaaacatattgggtatttattgactcatgggacttaaaatttctcagaggcattaatttctatgcctttaagcaaaataatgtttagcccgttttagaaagataaaaggctaacatatgttttgtttttgtttgttttgttttgttttgttttgttttgttgagatggagttttgctcttgttgcccaggctggagtgcaatggtgcgatcttggctcacagcaacctccgcctcctgggttcaagcgattctcctgcctcagccatctgagtagctgggattacagacacgtgccaccatgcccggctaattttgtatttttagtagagacagagtttctccatgttggtcaggctggtctcgagctcccaacctcaggtgatccacccgcctcggcctcccaaagtgctgggattacaggcgtgagccacggctcctggccgctaacacatgtttttaaaaaataaacaccattcgagtaggaaaagtgggagaactggtggttcagctagagatacggagatgggagggcaagttgctttctcatgttgccacatctgtaagttacaaatgccatagattaggaatttcaacgttgttgtgtctctctgaggacattctccatgtagtatatgtttcgcctccctgatggacagtaagcatcaaacggttactcctttatatttgaattattttaattctaacatcttgttctgaaaataacgggaatgccataaatacttactgattgattggactgtctcgcaggggagctggcagctagtgtaggctacaagctgccatcatcatctccatgaccatgagtcatcactggaattaccctaaagaggttaataaaacgccttgtttgaaaagcaaacaaaaagccagaagaaacccaaagcaaacagacccagactttgcaatgggtagtgaattttcagtcttaagggattgagagtccttttagtacaatctctcataaacatataacagattttaaaagcaccttggtctgattccagttcacatacctcatccttgcagaatacaacatactaggccatttgaaatgttcctcagtttacttttggaggatctgctgatttgagcaaaatggaaatgaaatgtatatagaaagctcttaatttttttttttttttttttttgagacggagtttcgctctgtcgcccaggctggagtgcagtggcgggatctcggctcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccagctcttaatcttaagaagttcagtttcgcagctccccccccaccaacccccaatcttgaaagcaggaatttggattagggttttttaataaaactttctttttcttattaccatgatgttttttgagagggtacagagaactcattaaaatgttatgttataacttaagacaaaatgggaatgagaatttgcattatataaacaaagtgtatgactaagtaacctgttacatataaagtgtttgactaagtaacctgttgtccctaggagaagtagaataaatatcaacatgtggcaactaacagaatgtgttgtgatcactaaagcagcacattcattgactttacacttcattaagtaggtaacgaattttacaaattttaggacttaaccaggctgtccataatactttgcatcagtaagtaccaaaatctacgatagggcacttcggagttccttaatttaataatattgataatattttgtttacattttgatttaattgtatcatttcattatttttgtgtcctgattctaaatatatacgtcaacaagctatatggccattcaaaacaggtaaactttaaatatgtttttgacatagaaattatgtaacagtcttcatcatgagtataggagtcagatttccaattgaaaatttcatcctctaaaatacttggcatatgtatacagttgtctagttcagacaaaaaagtattgaatataaagttgattttgtaaaaccagaattggcatccttaaggaatacaaataaagggaatcttaagataatataataatgctgatttgaaatgaaaattaataaaattgttattctattttagtatgctaaattggacagatccttatttcattgaaaaattagattcttcagtatatcagtgcactgtgctaataacacaagaagattaaattatgtccatatgtgatttggtagaatttaattataaatataataaatccttcaatatgtacagcagtgaatattccaaatttatctctcatataagttgtgagcaacttaaggataggcaccatcccttaacatacctagattaagaacagtacctagaaaacagtcatcaaatgcttcctaaataaattttcaccttcaagcttatggcagcaaattaaacatagattgacccttttctaatagagacagaatagatgagactgatgacttttttttataaatgtgtaagtctgcaaatatttagtaaggatctaatttacacaaagaaatcaacctagagtgagattattttattcatttcccggaggctgtgactgaattatatttgcaacttgccctaatttttatacttaataatttgcattagtatttaaattatgtgaaggaaaaatataagtttaaaatactgaaaagtatattcacacattcatcaaatgttgattatgtgcttacagtgtgcaaggtattggggctaggaattatgtggtgttccaaggaaaccatgatacagcctctttcattacagtgtttattattaggtagaaaaagtaaaattagtataatattagataggatatatgtgtcataggagtaatataaacaatattttatgaacaatgtatgaaggtataattttgttcatttatccatttatcgctctgtacatccatccgtttattcattgttcattacttcatttaataatactttagtgaccattggaaaagggatttataaaagtgagtaaaatgttaatcattttctaaagaagttgataatctagggaaagacaaatgtgtaccaacaataacttggatataaagcataaattagaggtacaagcaaagaaaaatgaaagtacaaaggagaaaaatatttggctgcatgagagcagggactgtgtcttgtttcatcatagattttccagaacctagatcagtgtttggcacaaagtaggttcagatgagtttgtgttgactgactgtctactgaagtaattgtggaacatatcatagaagaagtagatcagaggctggatcttaaaactgggagaaatacatttcagctccgtgaaaccccagaagtgatatttgacattagaaagcacaaagtcacactctaacagtgacagtactgagtgaagtaagaattttctgcaccccttcttcttcttccactcccattaacccttgttagggtgagaaatagcagctggtgaatggtagagaagactagcaagacagaaagaggaagcccaccatgcccactaccccaggtagtaaaggacctgtccacttccatcctcttctaattgaggaagaaatcatatatgtgagttcagattgaagtattgattaatatattgagctggatattctaattttaatgtctcgatatggagcaggactttgtttccttaatgatgaccagaaaagacatgaaacttacccatattttcacccaagaacagaacagaacaacctacttgaacagatttaaagggagaaccaaaggcagataaagttgtctttattcttacacagcataagtcctgattattcatcaatttatacattttatgaatttaagaaaaaaggaaaggaagactataaagggattcatatcaggatacacatgaaggtaatgtagtcagttttttagtggaaccaaaatattacagtcatcactgaacgaaaatattacaatcattacatcattcactagattaagtgaataaattaaaaatatattaaataaaattaacaaagacatgagcttttcaaagtgtgtggtaacctggagcaataagcagtgtagttggaatgttacctcttaaggattatcaaagaggctggctgttcagtaggacagtggtatggtaaagcaagcttgctacattgcagaactccagagggcaacattctaattatctttagctatggggtctgttcccataggataactataacttagtaggttgacagagcctcccaagaaaccacagcagtgctcaattgtggcgaattacttctctatcccatcaaaatgtcgtgattggacccacaactgtgcatacatttttttggcattttcctgccagaagcatatttacatttctttaatatccagtcatatccttcccttatttaaaaataattattcagagaattccagttttttgtaatcctctcttctatgaattttagcaacacttatatacagatacttgatattctggagaaatatgcttcaagaccatgtggattaacagattttcaaatgccgttatagtatatgtatatactatatatgtataagtatgtgtagtccccaaaatgcgtactttaaaatcctcataatagatctcttacagatgaggaaaagaagatgtagaaaggttacataaagtagctaacaagtattccaaataatattgaacttcagtctgactattccaaaattgcattcttaactctgatttctatatttgttttccattctaaactgtgtattgtgatataagttcctcactaaggctctttttcagggtcttcctaatactaaagtcactcttacaatgagtattttctttacgtgtgaaatccaataggcaaaaaaaaaaacttggcaataaattttaggcattaacctcatgccaagtaattatcagaaggctgtaatgctttgaaacttcacaagtctgattttaagataatggaatgaggcttgcattgtgaactttcttgatgctttacattgcaatatgctgtatagattgacttcctaaaaataaaaaataaaaaaaaagatttgtagagcatactgggaaggtcttgccaattaaaaaccggagattggctgaaggcttgcagcaattgaattttgaatacagatggtgtcaaatcgagtgtttccatagcaacagactcttccttaataacttttagatgggagggggtacataaaagagaaaaccatcttttagcagatgtatgttttcagcatgttttcagattgattttggaagctaatttgtacttaactagtgattgttttaagtggatctaaatattactaaattctcctgaggaaacattttgagaataacagaaataaactctaggaactttataaagacatgaaaagggcacaattttacaaaacctttttttttttggtctggagccaatcaaacagtattttatattgagtatgacctatcaatagtcaaagagttcttgattcttaatgcctgttaatattgaatgtttagaatatgggtaaaatcaaggaaaaagtgctatgtatctcatggatttggaatatcttaatatactctttcttcaggttaatgattatttttaaaaaatgatgatataaatcatttcaggaaggactgcataaagaggtcattgatagagttcatatcatatagcagagttgtcgtagatttaatgtccaatcctcagttttgcatagccaacaactaaattttagtagtttacctagagatgatcaggctctgggagactgattcatgctacacaaactcacaaggcactggtttataaaccatttgaaagaagaaataataattcaaactattattttacaacaagactggcaggaaaatcaataatggtaatgtgttcggggtgtcctccccagtgaggactatccagaagaccaaatgatagattattgttcaaagtgatagaattgggagaagggtaataaagcattatgaaaggatgcttccttaagtgagaaaagctacataaactacccatctttactattctagatgaccttaaaaatattaatagaaacagagaaacagacaattcatctcagatggtacaaaaaacataatagcacatgtttgctccctggcttccttttagattccctgcaagaggttttcccccaaccaccaccatatacagatatacagctttaccttcactctcctattatctgtcacagaacaatataaaactcagatatgttagtataagttaatagttggtagctttatgttaatgacattgctacctgttacccccagattcatctgggttacttcatccccaaaaccctttcaaaacgacatttcccacaaagatttctagtattactggccattcccggacatcttgcttccaacataagaaattctgacataatagggatataagaaggccttgggaatctgtatttataacaagctccccaggctatctgaggctcagccagtttatttttgcagatagctattactatccacaatctcttttatcctattgtaattgcagaagaaaatctttctttctagtttctttgaaatttctggaatgttaggacttagagcctctaggaacttgtacataaaaagagagacttaaagagatatcaaagtagagatagagatagatacagataagtgcatagacatagaagtagacatatataatagaaacatatatgtatacatagaaatagaaatatgccatttagaactcttaagaaatatgtgcactcttaaaatatagtttaaaaatgtaaagaacttgctattaattgaaaatagcataataaacttaaatgaaataaggaccccaaacgcaaatatttctctctgacacaccacacacacacacacacacacacacacacacagacagagagagagagagagagagagagagctgtacaataacaaccaattcctgacccagataaagaaaaaatttttatttatcttctttctcattctattattattttttctagattaaattaaaatggtaattatgtgtaagaacaagcattattgccatataaacaatgcaacaaaggaatcaattgaaaattaagtgaaaataaaaggtacagcttcgttaaagacccagttcttagagcttagtctcaaactctttgtactctgcactcttttcttgatttgactcgattgattgattgattgattgattgagtcagagtctcactctgtcacccaggctagagtgtagtggctcaatctcggctcactgcaacctccacctcctgtttcgagtgattctcctgcctcagcctcctgagtagctgagactacagacatgtaccaccatgcccagctaatttttgtatttttagtagagatgggacttcaccatgttggtcaggctggtcctgaactcctgaattcaagtgatctgtctgccttgttcccccaaagagctgggattacaggtgtgagccaccacgcccagccgattttactctctttagaactgcaaaagtaggaatctagctcatatgcagacattctagaaagtttgatttcaaaagtcttctcaaaagaaagagagcaagagcaagaaagaaagcagagagagaaagcagaagataaaatggcattgtttgaacagggatggaaactgagtaagaaatttggtcactaaacactttagtgtctatcatttaagattgtaatttggttatttatcactggaaagtgattaataatctaaaatgcattttataatactaatactattaaaacattaatttttggagaaagtttattatagattgatttatacttaccactgaatattaaaatgtttaatggaagtagtttcaaatagtatttaatgatatagggaattattacaacattaatgctcaggaaaaaaagtaggatatggaattatttatgccataggatcctaattttgtaaaaaacagagaaaaccagcaaaagaaattataactggaaggaaatacatcaaagtggtttgcagttatcactcatgaaattgaggtgaacttgatttttttccttttatatccatccgtgttttaataccacagacatgctttagatctgcccgtatattgtggctttcagagggtaataaaccattgtgactcagaaatagctaagaatttttatctctcaagaacaaattttcactcccttggggtgtcattatctgttgagaatgcatgcaatagttcaagagccaaaagactctgattcagtaagtttagggtagaaaaaaattaagtacatttttaaaatagagctctggtgtttcaaaggcaatgtgcaaatatacctacttaatattattctaattttttcaggatagctgaaatataaacatctatttttagtaataacacaaatgatggaatgcttttacatatttataaatcattaaggatttgctttttgtttctactgtctggaacatataaatttgaacacaatttagaacaacattcaggaaatatgatttatttattaccttcttgacctttattttatttttaccatctacttttatgtaagtcttttttttcaatcattgtttatttctttacttttccttccacatagaattaaagggagattcgggcttagtgtccttaattcatagttccattgtggctattaaaaggtgaactgaaagcttgcaaacacgtggtaccttgtagataattttctccagtcagacagttagataaaggcctctgaggtttctggggtcattgttgaagctatgttttaaaatcctatatccttctctcattgttggttccttttcacaacacagaagttttcttttttttaatttcaacttttagatacagaaggtgcatgtgcagatttgtcacgtgggagtattgcatgatgctgaggtttggagtacggatcccatcgccatgttagtgagcatagtaactgataggtcgtttttttaacccactcccctccctcctccctctagtagtccccagggtctattgttcccgtatttatgtccatgtgtgctcagtgcttagctcccacttataagtaagtgagaacatgtgatatttggtagaacttttcatttttaagttaaaaaacaaaacaaaatgaggatgagtggaagaactattcagcacagcaggttataaaccaattaggatgatgacgccctgaatggagattttcatgaacatctcatattagctatttcagctttggtttttttaatgttcaaagtaaatagaataatgaagaggctatttaggaaggtttagactgagggaaaaaaatcctttcattaggttccaaataacggttagcttattaaacagcaagaggcagagatttagcagagaaaaaataaaaagatttaaaaaaaaacaacgagattaaaaggtcagtaataccattggaactggcagcatggcaagtttatatcagctatcttttgttttggaacacaactatgctaattctgttctgaacctcttgctaatgcctgtctcaagaaaatttaacatactttatctgtgtgtacaaaaatacctaaggacaaagctattacccaaactgtattcagattgaaagaatccatatagaaatttgcagctaacgtattagtcagtgtatgtaatttctactgcttcacagcacaactctttctaattttcaggagcaatatagcaactgcttgccagccaagagaaaaccataggagcattcttatcattggagccaacattagttctgcctacagtgactaacatagatgcgtttattgctagctggaattttccattggcactagttacatgtaataagttagtgctttcaaatggaccgtggaatataggaaaactagagtctgacgtaaccaaaaaaaaatgttgataaactcagagattatgaaagagaggagaggagtggtttttgtggaaatgatagaaaagcaaaaaaagatggcaggatttggaaaaaagaaaatcaggttagagatttaattagtaaaggagctccttttaataattatataagagtatgagtttagagtaactgcctggctaatatgtacaatcttcaagttcagtcgttttccaaaattctaacttttagcattttttttttgtaaattttaagtggaaatcttccacttttgttgactaacttggctacctgatattttactcaacctcctactttcttgttctctacttcttctgagtctttgcttccacaatgaggtagctcatattccttaagtttcctgtctggttttgcttttttttttttttttaacagctaaaataaactctacaagcatttctatcattttctttacatccaatctcttgtcagccatgtcctaatcactttggtaaagtatcagtgaccacccaagaggttcactttgcttcgtcaaaggaccacctgtcatgctttatctccagagcttctgccttgaaagtaagaataatataacctttcctgaatgtcttatttcaatttcatgcatttgatctgcctcttcagaccattcccaaggctttgcccttgttctttaccctcatggcttcagttattcatcactatatgaatgacagctctcaaactgacagctctggcctctcacctatttcatctattccatatggcaaactgtctatattacatttcatcatgagggataattataattccacattcaacaagaaattgtgggtccgtgttgatttccaacagcaacctttattttttagactatgatagagaaagggtcaactttctctcttacttatttatctcaaataactcaaagtcaagctagaaaagccaagcaagtaatatttcccaacaaagcagctttaagcaaaatgattttcagacacgacatgcagcctgtattgtggaagaagcacagtgacctaggtgtactttgctgaaaagcagtggtcacagtccattagtttcatctttttcctgcaagagagaaaagtatggcagggccaagactcctaagaccccttaaaaaattgtgaggtttttataaccctgttcatttcccatcaaaagcattcatgaagcacctgccatgtaccagatgatgcattctaggcagagggaagaacttgggcaaagtcctgtacattttatcttctaaatcttactaatcttttcttatctttccatctaccacccaccatcaggctgtgcctggactcctatgctaacatcttactctgtttttctgcatcttttttgccctcccctccaatctactctccaattagcaacatgactaatgttttcaagcccagattagacggtgtcacttccctgctttaaacctttcagtggattcccattgcactgaggttgaagaccaaaatctttaccataactcacaaggccactgggagctatgaaaattttcttttttagtttttccttttaattagtgatgcattcaataagtggagtctatcgtgaaagcatagattccaaaggcatgtgaatactcaattatgtaatttacttacagaatgtttattacttcttttttagctttgattttgtatacatcctaactcaatctcagttatataagagattataaaaaagtttgtgatgaatgcatacataaaggaacaaataattaacaaatatataaagacaaatcagtattgaatgaccaaatggctctttatttattaaagaacttagaaaaatatagtcttgcttgagaccaagttctggcaacgtatgtgtgtctttttgtttgggttaaaaagcattagttttatatgttttaaaaggataggatcttcccttggctgcaaatagtataggcaaaatgctattctgtatcttattttaaagaaaataacaatcataccttattatttgctgacagttttgcagtttacaaagcactgttcacatggattaccttattttaaattcctcaattttttttccttttactatgggaattctgtttcaggagaatttccctttaaaattaaggtgattatactattctgttcctgtatttcgtagccatatgtttcaccaaggtattgtctctctccaggtctttcttctctggatgtatagttatgattttccaggaggtaaatgaaaacagtgggagcaattgacagagtgttttttgtttcccataaacccaagcattgcatttaaggagctgctgtactattgtaagagttcctatactaattttaaaagttcatttacatattttgtagatttttaggataagtcatcagaaaaaaattaaaaataaatttacatattttgtattaagctgttttgttacttgaatggggattattggaacgaggaaagaattacttttatctccccatttttcaaatcatttactataacattcatgaattgctgaagtttaaacaatcaaaaatatctgaaaatggagcctaggaagggtaacttatgtctttcatactccttcctttttggtttttctaccagcattttagtctaaaatatattttattttcactgatcctgtgtttgtcttaataatatagtatgtatgttaaatgaaccagaattcattgatctttttttttattattcctctttttgcttttctggagaagcatttgaagaaatcagttcaggctacacttcatcaattcatttcctcatcttccccttaatacaaaagccccattttcactcttcaaaacatttgatcacatacttaattttcatagcattgactaaatgtatgtgtttattttgtttatatattgcatatttgtgatgattttcacttttacagtttaggcatgggtaggaaggacacttacatgagtacttaagttcttggttatgacttgagaaactcacaaggtagcatggaatggcacgtaaacaaggctttgatagggtgaaagggaattatcaggacaaaactgactagtggcagtgacttttgagcagagtgctgcaaactgaaaaggcagagagcattgtaggcagagagaaagcatagacacatgtgagatacatgtgaaatacttagacaaatgtgaggtgtgtggtaacattgtacatacctagggctccttcctgtgtagctgtaaagctggagtataggcatcacaacaggcagcagaagccaagaaactagaaaagtagacaaaggccacgttataaaagatcttgtaggataggtaaagagttttaatactatcctgaaagcagtgtggggtgggaggcatgacattaaggaaatttaataagtgatgaaagaccaagattttcatcttcagaagacttctctggaggtgggtggaccacttgatgtcaggagttcaagaccagcctggtcaacttgatgaaaccccatctctactaaaaatacaaaaaaatagctgggcatggtggtgcatgcctgtaatcccagctactcaggaggctgaggcaggagaatagcttgaacccaagaggcagaggtggcagtgagccaagatggtgccactgcacttcagcctggatgacagagggagactccctattaaaaaaaaaaaaaaaaaagacttctctgactagagttttaaagaaggatggggagtgcaaaaggctaacattaaatcagtggttctcatccctggctgcacgttagaatcactagggggagtttaaaaaaaatgccaatacttggactccaccccaaaccagttaaatcagagccttaatagggcccagacattcgtagtttttaaagcagccctcttgattcaaatgcacagacaaggttgtgttccgctgaactagagagaccatcaggaggcttttaactaaagcaatctagggaagagagagatgaatgatatagaggccagaagagctattaaggagaagtgactcggcatcttcttggttaaagtataaggaagaaagaagaatgaaggataatttgcatgtttctccttcagtgactaagtagaggaacagatgtgtatcagtgattaggggagaggaagaatgaagatgatgtaatccagtttggatatgttggctatttcatagagatttagtaggcgtttggctctatggatacagagttcaagagacaattcttagcttaaaacacagattttactctgattattttagagatagtaaatgaagcaatatacatacatgaactcaccagagagaatatgtaaagtgaaaacaaaaagatcaaagggagacccctagggaatagcaacatttaaggaatgggcctaagagagtgaggagtggccaaataggcagaataaaatccaagaaggaatcttccatattaatcaaaagagaaggtttcaaagagggttcgtcaattggcaggtactgaagggatatctgaaaacataaagactttagactctctaatactgtagcaactttaaggtcactgctatcacctacaaaagtaatttcagtggcaaaagccaaaacgtaatggtttagaagggtatgtgaggtgtggatgtggaaatagtgggtatagactattgcttctcaaaatgtaatcacctgaaaaatcttattttaaaatgcagattttgattcattagctctagagtggagcctgagattctgcatttctaacaagttatcaggtgatgctgatgctgctcatacacaaaccatcctttaagtagcactggtgtaagccactctcccacaaaggaggaagacatagggtttccatcaggggacgcaggtggggtgtaggaccaaaggaaataatactcttttgtcttttgtttggttggttttggttgttttcttcttaaaataaacatggttgtagacggagattgaagacataggaggggtaaaagatggaatcacttctcatagaagatggaagagactggaacattgagtacagcgagggaattaggcatgggtaggagggacacctaaatctgaagagaaggaggtaaggaagaattgaaatacagaaaagttctgtcagtaagcaatgtatggaattgtgctttttagccatagtttctgttcaagaaattgttttccatttatttttatttcttaacttgaatagttggatggtggagtatgcttgtaaaaataagagtgaggccactttgtttttcggggttaatttccgttttctgcactcatcaagtaaaagttgaagtggcaaggtgtagatatgaaattcagtgtgtgctaagggagaaaaaaatgctttttattctacatgattttaaaaatatttatattccaacaaatgcatcaaatttgatgtgcaaatttacagtgatgaatgagttttattgtgtgcattgcatgctggtgacatggtaataaatctgtggtgctagaattataatggtcccctttagcttcgctttaatgaactcttgctgaacacttttgagttgttagtactttatttgctacatttggcacttaattagttaatgactgagatgctggaccgatggatcatctaatgatatgttaggcctattatcacatctagatagtttcttttctgtgacttgtaagtgacctaagatgataaactgaaatatttttgcatagatatacatcaagcttttctcctaacttcaggctttcatcttaagcaatagtttccaacacccccaaaagagaagtcattatgtttttaaaaaaattattcattttaatgtgatcaaataatatcacatttcagcattcacctatttaattaataaaacaacttacatgtttcattatgactggatgttgatattttttcataatctattatcctccaaccagtggtaaaaacccaatcctcctctcacccagctcatctttccgtatgggaagcaatacatacttccctatgttttattaccaaaacaggagaatgagctttctttagaaggttaactcattttctctattagaatattcagcatacttttaaggaggtaatctggtctttgacagtctgttgattagaaaattaagagacctgcctaaattccatttccaactcctctccatacacattgtgactttgagcaaaacgttttgccatttccactcgtataagttctgtttagtatctttaaacttccatatcccacagatggtatttttttcttcattggaaagtggtgttagtgattcagaaaactgcttaaataatacactgctttgtgttttctgtgagagaatttttttttttttttgagacagagtctcactatgttgcctaggctggagtgcagtggcgcaatctcggctcactgcaacctctgccgcccgggttcaagcgattctcctgcctcagcctcccgagtagctgggattacaggtgcctgccactgcgcctggctaatttttgtatttttagtacagacagggtttcaccatcttggccaggttgatcttaagctcctgatctcatgatccgttcacctcggcctcccaaagtgctgggattacaggtgtgagccaccgtgcccagccgagagaacattttatctaacattctattttaaaatttttcaaatacacagaaagctgaaagaattgtacagtgagtgctcatgaacccactctctagattttgttgtatcactttacttctttctctacccgccaacccctattattttctgatgcccttcaaagtaagttggtgacatcggttccctttacccctaagttcttcaacatgcatgtcattaaccagagctcaatatttgttcacatttcttttgtttgtttgtttgtggcaaaatttgtatagactagaatgtgtaaatctcatgtgtattatgaaatgagttttgatgaatgggtatacctgtgtgacacatgcctctcttaagatacaaaaaaatagccttggcccagacaggagggaacattttttaggttggcttgagtttcctttaactgacatgtagcatgactgaatatatgaccataagattgccaagttgaaatttaccaaaggtccatccaggggaacagtatggctattgatacgtcatttgttcatctaggcactgggctgggtgagttcttcacaaaaaccttgtaaggtgagctttcagctctgacagaggcatcaagaaacgtatttcacaaactgttagagctgaaaacatctccagggatcatccaatctatcctcctttgctttatgactcaggatttaagaagccccagaaaagtccaacagtgttaccaaagtacacgattgcctatttacgcccctataattgagagctgtctaggggtcaggtacttttctcagtgccttgtgtacattatttccttttatctttctagattattaattttcttgttattatccccatataatagaggagtaaacagtgtgaaaatagcactaaactgttgatcttttccatgttccaaactaaccttaaatgttaggctaatattataaaattttaaaatttagtcatttgttctgggtctggcttccatgaacttaaccaaaatgcttggctgtttctgcattctagctttttgggatttagagaaaaagcaacttggtcatcatagtggccaggatttatttatgtgccaataactcccctctgtttttagctttttgatctgttacatctcagatactttattctctatttgtaaaacaaccacattcctccttttctatatctaagtgaaaaaaaatgcccgttcatactagctacatggttagcatatatgtttcttcctctttgtgggtttgagttgaaacttcttttgcaaagcttaactatagataggtcttccacagaaccctgtttaaatgccttgtggaagtagaagggacatatcttaatattccttataatctgtgttattatttggactttcctcagttccttatatgtctttgtatgtcaaacattgagttatgcttacattactctaggtatagttgtgtcctagctttgtacaaggttacaataatggtggtttccttgttttcagcttcattcttgatcatgcctaacattttttgatggttttagcctcggagaacagtctactgctatttctccctttttcctgatcccaacaaatagtttagaaatctttgtcttaactgcaattgggatcatttttcctttagagttgcccacagttagtcatgtccgtcactcttcactcactcaaatgacctcaaaagatttacctgcaatttaagcctttcaccttggcattttctacctggaactctggcgtactctgtgggatcagtgagatccatagtgtgcactccctagcagatcgtgaatgtttgttgataactataattcattgtttagtcttgtctatacagagaagcagtagcaccttgctttagtaggatcctttatgcttttattcattattgaattttatcttcacaataattctgtggttctgcagttgtcattatttcagtttgggagttgaggaaactgagatcgtggcaaatcaacttttcccatttaaatccactatttcatcgctaatccagggttataacccaagactaactgctagtcaaagttgctttctaaaaatcagttacacagacttctaattctcgtgctgtacagtcagtgcagaaattgcaacagaactgttctttgttctgtagcaatgtgtattcaaaaggtaatcatttcttgtgtataaataacattcctccctaagagagatgttgtgggaatttatatcagtcaagaatgtatatcgataattaaacatagctagtctaaaaaacttgaagtgaaagattggttcgtattcaatcaactgaactgtttctttctctgcaatattgtggttcttgacatgattgctgagtttccaatttgacacttctggaggttcgtaaatcaggacacatgctgggtctcagtctgtcatcctgagtcttagcattggttatttatttccctttattacccaacatctatttactgcacaaattagtcgagaagctttccatgacggacctttgtgagaaaaaaaaaatgtgtacattgggtagctcttcaattacaaacatgcacagattgtctgggtttatgtgcatatactttattattatttcacttttgtatgtcagatgaatttggtgtaaatgtaaatctaacaatatgggctctagtggccaaatacattgccataatatgtttttgatctgtcagtctcctgggtgaagtgtcgcaagtgtggtaaaattctgtagtataaattgatgctcagttatggacaattaccaggtctatatgatgtcagactaccacactgatccacttttaggataacagcttcgctctgatgatcttcagattttagatttgctttcattccttgacaaaatgaaatacatttaaaacttctaaaattgtcttttgtatatatttctgcagggtctactcttgggactactataacaatcaattgtactgctttgtttcttttattaaatagcagaatagctgcttgattcgtctgtatgtgctgatgtgtgtctgtgaatctagtccagttcactgtccaataagaatttctgaaatgttctttgtcacatcaatgtacagtcaaaatcgtattgtgtttgtagcagaatgattgcatcttttattattcacagcagccaaaatgacacatatttcacacgtgacaccttttttaaaaaagatgaattgtccaaagttgtatgtagaatatatttcacaaatcaaattccctatttaataaatggtgctgggagaactggctagccatatgcagaagagtgaatttctataaatagaatgcaactgtgtaaatagcatccaaatcaagaaacataatataatatagccagaagctcaggatcccccttcatgtcttctccagtcatgaacatttcacaagggtgactactatccttacttcaaaagttttctattactttttcctgtttttgtgtattatatgaaggaatcgaacagtcatatctacttgtctgtggctgtatttttccccccaacaatatgtttgtgagattcatccatattattgtatgtagttgtggattgttcacttttcttactgaataatattctattgataccacagtgtatttacacatgttgatatagatgagaaattgagtagtttccaacatgaggaaattgctgtcaacaattctgcaatccatagccatgctatcaacagtctagtacatggtttttggtgaatatattaataactatgcatttctgttggatatacacctgggagtggaattacaactcaaataatattcattttaaaaattttatttcgtttttagtcgacaactatattatggggtacattgtgatgtttcaatccatatatatacattgtggaataatcaaatcaggctaatagcatatctatcacctcaaatacttctcatttttgtggtgagaatatttaaaatcctcctttttagctatttggaaatatacaatatgacaatattagctatagttcctgtgctgtgcaaaagaacaccagaacttattcctcctgtctaactggaactttgtacccattgataaacgtctctcatttttccatccacccaccactgcagcttttgatcaccaccataatactctccatttctatgagttcaactttttttaaactgcacatacaaatgagattatatgatatgtgtctctctgtgccaagtttatttcacttaacctaatgtcctccaggctcatccttattattccaaatgacagaatttcctaggtttttaaaattttttttttatttttaattttttggggtacatagtaggtatatatatttacggggtacatgaggtgttttgatataggcatgtaatgtgaaacaagcacatcatggagaatgaggcatccatcctgtcaagcatttatcctttgtgctacaaacaatgtaattgtacttttagttattttttaatgtacaattaaattattattgactatagtccccctgttgcactatcaaatactaggtcttactcattctttctaactattttttgtagccgctaacaatccccacctatcccctacctccacactaccctttgtagcctctggtaaccatccttttattctgtctccatgagttcaatagttttaatttttagatcccacaaataagtgagaacatgcagtgattttcgttctgtgactggcttatttcatttaatgtaatgacctccagttccatccaagatgttgcaaatgacaggatataattcttttttattgctaaatagtaccgcatcatttatatgagccacattttctgtatccattcgcatgttgatggacagttagcttgcttccaaatcttgcctgttgtgaacagtgctacaacaatgtgagagtgcagatagctcttcaatacactccctccttttcttttgagtatgtacccagaagtgggatttctggaacatatggtcattctctttttattattttgagaaacattcatactgtctttatggaggccgttactaattcacaatactaccaatagtggataaggtttccttattctctgtatcctcatgaacacttgttatctttcaactttttgataatagccaatccaaaagatatgaggtgatatctcattgtgattttaatttgcattttttgatgattagagatgttgagtattatacatatatgtgtgtgtatatatatatatatatatatatatatatatatgctgtttgtcatcttttgagaatgtctattcatatatttgcccatttttttattagggttatttgttttcttgttattgagtagcttgagttccttgtatattttggatattagcaccttatctaatgtatgatttgcaaatatcttctcccaatctgtgggttgtctctttattccattaattgtttcctttgctgtgcaaagctttttagtttgatgcaatcttacttacctatttttgtgttgattgtgtttgggggtcatatgcaagaaaccactgcccagaccaatgtcatggagctcttctcttatgtttttgtagtttttagtttcaggtattacatttaaggctttaatccattttgagttgattcttgtataaggggtgagataagggtccagttttattctgtatgtgaacattcagttttcccaataccatttattgaagagactgtcctctccctattgtgtgttcttgctacctttgtcaaaaatcaattgatcaaaggtgtgtaggtttattttagtcctctttgtcttattccattggtctgtttttatgtacttgccatgctgttttgattattatagctttgtaatacattttgaaatccagtagtgacatacttccaattttattctttttagtaaagacagctttggctatccagggtcttttgtggttccatgcaaattttaggattttttaaaaaaaattctataaagaacaatatgcagattttgttagtattgtgtcgaatctttagattgctttatgtttaacaatattaatttttccaatttatgaacacagaaatctttccatttatttgtgtcatcttcaatttctttcgtcagtgtcttatagtttcaacacgcagatctttcactttcttggttaaattcactccaaatattttttcatgctattataagtgagattgtttccttaatttctattttagacagtttgttgttattgtacaaacaataacaattgttatcgctactgatttttgtaagttgattttgtaccctgcaactttactaaacttgtgtatgaattctaacagttttcagtggagtccttaggatttgctgtataagattatgtcatcagcaagaaggggcaattttacttcatccttttcagtttggttgccttttatttctttctcctgcctaattgctctggctaggactcccagtactaagttaaacaagggtggggagagtgggcatctttgtcttgctcctgatcttagagaaaagccttctacgttttactgttgtgcatgatgttagctgtgggcttgtaatttatggcttttattcttttggagaacatttcttctatacctaatttgctaagagtttttctcataaaaggatgttgaattttgtcaaatgctctttctgagtttattaaaatgatcatacggtttttgtacttcattctgttatatgttgaatcacatttattaatttgcatatattgaaacaaccttctatcccagggataaatccctcttggtcatggtgaataatccttctaataaactattaaatatggttcactagtatttcattgagaatttttgcatctaatttcattcgtgatattggcctatagttttctttccttgtagtgtctttgcctggctttgggatcagggtattgctggccttgtaaaataaatttggacgaatcccttcctctttagttttccaaaagagtttgagaaagatttgtgttaggtcttctttaaatgtttgtagaattctcccatgaagccatctggtcttgagctttcctttgatgtgagaacttttaaatactgatgcaatctccttaactctttccttagctgttactggtcttttcagatttccaattttcattattcagttttggtagattatgtatttctaagaattcatccatttctgttaggatgtccaatttcttggtatataattgttcatcgtagtctcttaggatcctttgtatttctgtgttatcagtcataatgtcttctctttgatttctgatttgatttatttgagcctgctctcttcattcttagtctagctaaggatttgtcaattgtgtttagcttttcaaaaaaccaacttttagttttattgactttttttctattgtttctctagtctctatttcatttatttctgctctgatctttgttattttcttctttctgctaactttgggcttaattcattcttctttttgtagtttcctgaggtataatgttaggtatttcatttgagatatttcttcttttttgatgtaggaatttattgatataaacttccctcttagcactgcttttgctacccccagaagtttttctatgttgtgttttcatttctgtttgtctcaagacttttaaaaaatttcctcttgaatttcttcttttgacccaataattgtttaggagcatattgtttagtttccacatatttcttaattttatatgatttctcatgtaattgatttctaattttatattgtggtcagaaaagatacacgatgggttttcttaaatttgttgagacttgtctgtggcctaacatatgatctatcctggagaatgttacatgtgtacttgagaagaatctgtattttcctactgttcagggcacaatgttctgtatatgtctgttaggtccatttggtctaaaatgtcattcaagtccaatgttttcttatgaatttttctgtctattgcttaaagtggaatattgaaattgcctgctattattatgttataggctatgtttcccttcagatcccttaatgtttgctttatatatttaggtgctctgatttgggatgcttatatacttgttatgtcctcttgatgaaataacctttatcaatatataatgatgttctttgtcactttgaacagatttgacctaaagattattttgtctgaagtaagtgtaactaccctgctctctttttgttctcatgtacatggagtatcttttttcatccctttactttcagtctatgcatgtcctttaaggtgaaatgagccacttgtaggcagcacatatttgggtcttgttttttgttgttgtcgttaatccactcaaccactctatgccttttgattggagagtttaatctatttacattcaaaataatgatggatgggtaaggacttactagtgtcattttgttcattgtttcctggttgtcttacagattctttgttcctttcttcctctattgctgtcttcctttgtgttttgatggttttgtgtagtagtatactttgggtcttttgtttttatcattcatgtatgtattataagtttgtgctttgtggatactccgaggcttacataaaacattttataagctgataataacttaaatttgattgtgtgcatatactcaacactttgactctccctcctcccacattttatgtttctaacatcacaacttacttttttttttaattatactttaagttctagggtacatgtgcacaacttgcaggtttgttacatatctatacatgtgccgtgttggtatgctccacccattaacttgtcatttacattaggtatatctcccaatgctatccctcccccgtcccctcaccccacgacaggccccggtgtgtgatgttccccttcctgcgtccaggtgttctcattgttcaattcccacctatgagtgagaacatgcggtgtttggttttctgtccttgtgatagtttgctgagaaagatgatttccagcttcatccatgtccctacaaaggatgtgaactcatccttttttatggttgcatagtattccatggtgtatatgtgccacattttcttaatccagtctatcattgatggacatttggattggttccaggtctttgctattgtgaatagtgcagcaataaacatacctgtgcatgtatctttacagcagcaggatttataatcctttgggtatatacccagtaatgggatagctgggtcaaatggtatttctagttctagatccctgaggaatcgccacactgacttccacaatggttgaactagtttacagtctcactaacagtgtaaagtgttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatatccttcgcccactttttgatggggttgtttgttttttcttgtaagtttgtttgagttctttgtagattctggatattagccctttgtcagatgagtagattgcaaaaattttctcccattctgtaggctgcctgttcactctgatggtagtttcttttgctgtgcagaagctctttagtttcattagatcccatttgtccgttttggcttttgttgccattgcttttggtgttttagacatgaagtccttgcccatgcctacgtcctgaatggtattgcctaggttttcttctagggtttttatggttttaggtctaacattaagtcttcaatccatcttgaattaatttttgtatatggtataaggaagggatccagtttcagctctctacatatggctagccagttttcccagcaccatttattaaatagggaatcctttccccatttcttgtttttgtcaggtttgtcaaagatcagatggttgtagatgtgtggtattatttctgagagctctgttctgttccattggtgtatatctctgttttggtaccagtaccatgctgttttggttaccgtagccttgtagtatagtttgaagtcaggtagcgtgatgcctccagctttgttcttttggctcaggattgtcttggcaatgtgggctcttttttggttccatatgaactttaaagtagttttttccaattctgtgaagaaagtcattggtagcttgatggggatggcattgaatctataaatttccttgggcagtatggccattttcacgatattgattcttcctatccatgagcatggaatgttcttccatttgtttgtgtcctcttttatttccttgagcagtggtttgtagttctccttgaagaggtccttcacatcccttgtaagttgtatttgtaggtattttattctctttgaagcaattgtgaatgagagttcactcatgatttggctctctgtttgtctgttattggtgtataagaatgcttgtgatttttgcacattgattttatatcctgagactttgctgaagttgcttatcagcttaaggagattttgggctgagacgatggggttttctaaatatacaatcatgtcgtctgcaaacagggacaatttgacttcctcttttcctaattgaataccctttatttctttttcctgcctgatcgccctggccagaacttccaacactatgttgaataggagtggtgagagagggcatccctgtcttgtgccagttttcaaagggaatgcttccagttttgcccattcagtatgatattggctgtgggtttgtcataaatagctcttactattttgagatacgtcccatcaatacctaatttatcgagagtttttagcatgaagggctgttgaatttggtcaagggccttttctgcatctattgagataaccatgtggtttttgtcgttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcgatgttcatcagggatatttgtctaaaattctctttttttgttgtgtctctgccaggctttggtatcaggatgatgctggcctcataaaatgagttagggaggattccctctttttctattgattggaatagttttagaaggaatgataccagttcctctttgcacctctggtagaattcggctgtgaatccgtctggtcctggactttttttggtttgtaggctattaattattgcctcaatttcagagcctgttattggtctattcagggattcaacttcttcctggtttagtcttgggaaggtgtatgtgtgcaggaatttatccatttcttctagattttctagtttatttgcgtagaggtgtttatagtattctctgatggtagtttgtatttctgtggtgtcggtggtgatatcccctttatcattttttattgcatctatttgattcttctctcttttcttctttattagtcttactagcggtctatcaattctgttgatcttttcaaaaaactggctcctggattcattgatttttttgaagggttttttgtgtctggatcttgtaggtatgcttcattgtttcttattatttttttcttttgtcttctctggctgtgtattttcaaataggctgtctgcctacaagatccagaaaatagcctcaaaagggtcaatctaagagttattggccttaaacaggaggtagagaaagagatagggatagaaagttgatacaaagggacaatatcagagaacttcagaaacagagaaagataccaacattcaagtacgacaaagttatagaacaccaagcagaattatctcagagactacctcaaggcatgcaataatcaaactcccacaggtcaaggataaagaaagaatcctaaaagcagcaagagaaaggaaacaaataacatgcagtggagcttcaatacatctggcagcagatttttcggtggaaatcttaggccccgggcatatccagagatgctgtctgagggccagtcattggagtcaaaaaccttagcagtttacctcatgttctattctattgtggctaagctagcactcacaccacaatataaagtgctccctgctcttccttgcccttttaaaaggcagaggatcctctccctgtggccctcaccaccatgagggttctgcttggcctccactggtgttcacttaaagcccaagggctcttccatcagcttgtggtgaatgctgagagaactgggacccatattttagggccttgggctcccctctggcccaaggcaggaccaaaaatgctgtccaagaacctaggccaggactcagaaatcccagaagcctgcctgcttctctgcctttctgtggctgagctggtacctaaggggcaagacaaagtcccctttacttttctgtctacttttctcaaacagaaggggtctttcaccataaccaccacagctgggaatttgctgggtgacctatgaagccagcacatctcagaggccaagtcccacagtgtactccctgggtattgcaactggttattcaacgttcaaggcctctttagttagtagctgatgaatcctgataggactgagtccttccctttaaggtagcagattcccttttggcccagggtgtgtctagaaatgctatccaggaactagggcctggaatgggggcctcatgactctgcccatgccccatcctactgtggctgagctggtatccaagatgcaagacaaagtcttctttacttttcgctctcttctccttaacgagaagtaaggagtcacttctgttgctgcaagcttcactgctgggagtaggggaggtatggtgcaaccactcccttagccatgccagctggtgtctccctaggtcatgtgggagaccctaatccactggcttcaatatatagagggacgtttctaaattatttatctgtaatttgattaagaagatagacacaggcaataggatatgccaacagattctctctaacctatagttattttaagaaagttagggaaagagaggtcattgattagttttggcttactgaattatttgaccctcccatatcttttaatttatggattttatataaggcacagatattctactagtaaacatgacattaaagatgttttatacaaatgaatgtggttgatacaaaggcattaaataagaaacaaaggaaattcagaggacatttgttcgcctggaatagagatcattagcataagcataagaggaaaataaggaaggaaatgggaaagtcttgagtccattttcaaattatgaaaacttgaaatgcaacaaacaaatagtggttacttaagaagaaagactgaagatgctgggcaaaggttaactttagaaatggcatttttatatcattataaagagaaagtggggataatggaaataatctacatgtacaactcatttgacagacatttattgaaggtattccaaatgccaaacactagtttgtgcactaaggatgtttttaatttttactttttactttatttttattttctagcttcttccgctttgccagagaaggatttttttaaatggataaaatactaacttaggctagcttctttcagaaacagacctttaaacaatgattaatggtgaaagtggtttggttgtaatgtgatcccaggaagtaccagtaggagagtgggacaatgagataataaatgaaagaagccaataattaagccagttatggaactagttattgctttgggccactggggtttgatcctgatgaaggagctctgggagatagtaaacaaacaaacaaacaaaaaacatgcctcaaagttgtcaaccacaagggggtaaaggcaaggaaccagggctaactattccaactcttatccatcattggctaaatgcttcctggtacataaactttccagcacttctggccagcgcacctagcaagctgaggaaaatctctcaggtttgcagtagggcaaatgcttgtactaggacactgctggcatatacttgaaggatgagtgccaacggcagatagatgggccctgacagcatcttctacagattctgtccttgcctttgaggcaaggacactgtctagagtcagagacagaaatgtaaaatgtaaaaatgtaaatcatagtagcacacagtacaagttttaaaatcttaacaaagtgttatgggagaaccacggtgagagaaaatgactgcacatatgagagcaggggaagtctttatatgtgatgatgacatttgagtgggtgttccgttatcaaagatctacttaaaagggaaaaagagtagaattattttaaaccatggatgtaaccaggcgtggccaccctatatgtgaatgtcctgggataattttgtccccagatgtctctctttttgagtgtcattttcatttatgtattcataatataaagaaattgaatagaaagaggtaaacattggtggcaaaaatcccttcctacccataaggctcacagaataatgttgtctaaatgccataacatttttggtaagttttggttctatgggctttggaaattttttatgtaggaactcctccaaggtgatataagcattcagtgtatttatctagataccctagttaaagctactttaagcaggatcaaagtcctcttttaaacttttgtatttgaaagctattcccatgtacaattcccatgattcttgtacaattcctaggagacctttgtttacatcaaaagagtttgtctctctctataagttagaacttgtacattgtagtaatggaaaatccatttcaaagtagcttagacttactcagacaaaatgtattgatcagtgtcattaaacagttgaaagatagacgaggcttgattcaggaattaaatagcatgaccagattctagttttccttctccattgcatggctctgctccccagtatttgttccgtttaattcctcttaattgttctaagatggatatcaggatactgcagaactacgtgctttctcatccatcttaaacaagaagcaatgggttttctcttttagaatcacgaacaacaacaacaacaacaaaaatcctagagttgtttcattggttctgattgaccttacttggaaccataagtccatctttgaattaaccactaaagccagggagatgagttaaaactaagtacacaccatccacagagcaaagagaggtctattgtgggaaaactgcacaaatggaaaaataacaggggaaacacaggagaaggaggtagttagttaatgttcaatacacgcaccttctcagggacttttcttccatctggcatcatctttgtcttttgaccattttccccaatcaatacctatattcatactcaagttttccatatttgggaaaaaacttctcttgacaccaaactcccctctgacttccttcttataatgatctatggttggatagtctacaatttactgtccttactttttcataggtattttttaatctcctacagtaagatttctaccactgcactgaaatcattttgtgtatggtcttcagggaattccatgtggccaaagccaatggatacttttggcatgggctttggaggtctaacttcttgaatccaagtgtcggctctaacaatcactatctatgtgaccttagaccagttatttaacgctgtctttatttcctcatttgttaaatgaggataattgcagcaatagaaaaagaacgtaaacaattatacttataggattgtatgatgattaagtgattaatgcaaggaaagaacaacacagagcttcagacagtgtagatattcaaataaatgttagttatgatttttattatgtcttgtgacatctatgagatttgaaagtgttaatcactcttgtgtttttgaaaatctttcttttccatgttctataaaagtacactttcttgatattcctcctccttctctagtctttcattcatcttatttgctctttgtgttttatttattctttttacgttgtattttccaggagtccattcccagcccggtgttgggctcagtctatgtgccatataaatgagaatgcacttgcatttgaggctttgctttttatttctctgtagtgacggccaatcccagatttctgtctctcccaaaatacacagctatgctatagatccttcagtcctcctgactaaaatgttagttttatgtgtgtgttcctcacaacctcccagtgaataggtccaaaactgaactcattatcttctccatgctcactctgcattctttggataggcagtgaatagcaccactatctaacaggcacctaaaccagaagccaggtaatctgtcttaaacccttttgttttccaagttcttatcataatggctggtgtctaacagatggtaaataaaatagagactagctggctacatggatggatgtgtggggatgcacagagggatagatggattattgagtgagtctctagcctataaatatttttaattaactaataaattatgataatgtacagttgaaggtcaagggtgaaaaagcataccctcagtgggatgcacaccccaaggagccattttaacttgctacataacacacatatgaccacttttttgctgaaagccttctattattgagcaagcattcaaatcccatgtttgcctgaaataatggttcaggttataaaagtttccttctttttccaggattaaaattatcttcctacataataggaagaactgctttatcttttcctaatatctagagatggccttttaaaaatatagactgttttccctattgaaatgaactgtaggatgtacaaaatatttactggcatgaatcaaaagagcttgctatgtttatgtgaaaaccactaggcattctaaaaaatattgctagcatagtaaaatgttagtaattaagactaacgaaagcgaaggcaaattggaatcagagactatttttaaggaatgtcaactgtattattttcaaatacacatggtacataacagtaggatatgagaaaaagtcccaagtatgtgtactaaagtagcctgctatgataagttgaaaaagggtttgtaattggaatatccacagaatatttcagaacacttaaagacattttcatttacactttatacagctttcttataagagcatttacaccatttattttataaaccaaagattaattagaagactaaacaattacaaggcctcaactacgaaagctgttccactacctagtggaacaacaacaatgagacacacaaaacaatggcgttcaaagattagagagagacttacggttaaacagaggttgacatgttaactgaagttgcaatataatatgtcgactagttttgcaatacatagcaaacacccaaacagaaataaacctgataaaaaaacagtagtctataatgtgtgccacttactgagttttaattattctggggactatatttttgatttcatgttacaatcactagttttgtggggtctttctagtcctgatgcttatttacaaaatatctgaagtatttctttctatgtatttatttttgagatggagttttgctctgtcacccaggctggagtgcagcggcatgatctcggctcactgcaacctctgcctcccgggttcaagtgattctcctgcctcagcctcctgagtagctgggattacaggcgtgtgctaatttttgtatttttagtagagactgggtttcagcatgtcggtcaggctggtctcgaactcctgacctcatgatccacccgctttggcctcccagagacctgggattacaggcgtgagccaccgcacctggccatctcaagtatttctttaacttataacttcacataactttgtggaggcaacagggttaattaaaaaggactttacttacataacaaaataagaagcatagttttatattcctgtgccatatacattttgtttgtccatctgtagccattctttgaccttctctcccttgctctttattctgggaggctgacctctgtcatcattgggctcccatgccctttggcttccagttggtttaggcacccaagagccctagaaggaaattgaagacaggaggtaaagtgaggtcaagatatttattctcctaattccctccctttgaggttgccacaggctgactatgtcctttgacaaaaggttattgctcttctcagggtggtttctcattccaattctctgcttttggccacttttccctcccctcatcccttgggcctagatgtagtaacagctctactgttgcaaggttcttgtattatctgtgatggtttcttataccctgcttatcttgtgatttgttgctttgtagataaacctctcagattatctaggcaagatcatagaagaacacgtatgtccagctaagatattccagaagacagtagggaaacattgaagggttttataagagggagtgcagtgatcagatttatgttagttttaatctttaattggggtagaatttacattctaaaacagagatttgggtctgggaggatgatatagagcctcttatggatgtgagggcaaaaaatgatagaggtttgcagtgccaatagaaagaggaaagaagttatatatgagagaaatttgtaactaattatatgaggtgttgggtgacgcttaggaaagaatctagaatgtctatcaggtttcatgcttaagggataaagtagatggcagttttattacttgttttctgtattatttttatttcataaaaccagcttagagaagttgcatagaaaaaataatgtagtcctgtttattttaatatttgaaaagaacatatttcagagtagaatctatatagtacctccctcttggacttccaatgataccagtgatagcctcaatataagccagtcttacaaaatgcacccagcgtgaattcttaggtattgttaaaagaagttggccaggcgcggtggctcacgcctgtaatcccagcactttgggaggccgaggcaggtggatcacctgaggtcaggagtttgagaccagcccggccaacatggtgaaaccctgtctctattaaaaatacaaaaaaaaaaaattagctgggcatgatggcacgtgcctgtagttcctgctactcgggaggctgagacaggaggatagcttgaacccgggaggcggaggttgcagtgagcggagattgcaccattgcactccagcctgggttacaagagcaaaactccatcaaaaaaaaaaaagaaagaaaaagaagaagtttctaatacacttatcttcccttgggttcactcagaagacccttggaaaaggttttaagagcaagtgatttatttggggggtaaattaatcagtagaagagtggaaaaatgagacaggtgaggcaaggcagccagtaaagagtggtgcattatcaagccagctgctgttgtgggtcactggagctttatcccttgggaaactctggaacccttgtaaaatacatgcctcagagttatttcccctagcatcaagggagctagtgtaacaatatcccaattcctacaattagtcattatatacaggctgcctctgggagctggaggggaggcatcagttgcctggtatgtctagcctgtcacatggatggcaaagcaaactcctgtggcaacagaaagccttcaggcaatgaaatgctggcactgggaaatcaggctgatgggtgctgaagtggcaaggatgaggggatatggatattctgctgtagtgcttttctaacagatgattcatatttggttctagggatcaagaattgagttaaaattttatatatatgttgatgttctatgtcaccttcaggaaaataatttaacagaaactaatatttgccatcaaaaaagcaaagaatcctgttgttcatcatcctagccataacacaatgaataattttttaaataagcaacataaatgtgagataacgtttggaagttacatttaaaatgtctcctccagactagcatttactactatatatttatttttccttttattctagttgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaaggttagtatcaaagatacctttttaaaataaaatactggttacatttgataaaattataccatagattgtaatttaatgatgtttaatgtaaagttattaacagaaaatcacgttaaagctgaaatgaacagtagactttgtatatttattttcttagagacagagtctcactgtcacccaggctaaagtgcagtggcacaatcatagctcactgagccttgaactctggggctcaagcagtcctcctgcctcagcctccctagtagctgggactactagccaggcgtgtaccaccacgcctggctaattttttaaaaatttttgttttctgtagagatgggttcttgaactcttggcctcaagcaattctccttccttggcctcccaaagcactaggattacaggcatgagttagcatgcctagccagtagacttttgagtcaaggtagagaatagaggaaaattgacagctaatgtcaatgttaaagttaattttgtttagtaatctggatatagttggctggttttctgttgcaccatctttaagatcacttcaaaattggtatacgtatttatgtagttgcatgaagtcaaccattcgggcttaattccttcctagaaaaagtaacaggtctactctttcatatcttatttggaggccctggatcaagaaatgggggtgagtgggtatcaggattggggaggaataaggagtactctcactttctccccccattctcttacctccagcccagctcattcttctcttctttctctttcctctgaaatttcctcaaatatctgtctgcttagtagtctataattcctcaggataaaagaaaaaggaaaaggaagaaaattgcttaataactatgttttatcaagcagcatgcatagtgctttgcatgcgtttaatcccttcaaacttagtatttactagtcagtttgaaaagcccttaaatgttaaacaatggttaagctttagggtattttgagcagggaagtaacatggtaggaggttgatcagattgggcacttgatcaaaaccctctatagatattttatctgacagaaaaggccttttgctaaaccagtatctgattctcaaattggttatgtcatctaagaaggaaaccgtatcattttcttggatgaaatggcttccatttccaaattagtcaggttaggctatgctaagctatagtaagaaatgaactctgaaatctcaatagcttaacacaataaagactgctttcttggttatatcatagtccagtagaggttgacaagccattcttaggagctgtcccccaacatggtcacttggaaacccagacttttccaattttgtgacacttgtcattttcaacacactgccaaaagccactgcagaaaaggaagacagaatgtggtcagtcaatccatggtgttttatggccaggcctggaaattatgtatatcacttccaccacatcccatcacacagaacttgttctcgattgaatttcaggaagagttaatggaattagtgagcttttagccaatctctgtcatagccattttatcgaagggacctgagctgctatgaggacaaggttttagtttatatgatgaggatgttagaaagccacatagaattttacagtcttatcattagctctgttggagtcaaaatctaggtgaataaaaattctttcaagagacacatgttaccactaatggttttttcaatggatgagcatagatgaattaggaatctccaatggtcattttcctaattcctggtctgactatgtaatatatagaatcatgtggttattcttgaaagctctagtcatattcgtgaggtagtcagcatgttatgctacttctttttcttctctataagtttcggatactatgaatctattggatcacaaaccaaagtagttaactggtaagaaggtataagcagaaaatacgaagtttggactggatccttgagttagatgagaagaaggagagatgagaggcatacagtgatagatttgactagggcaagaggactctggtagttagcaaatgagaaataaatttaacctaagaaaatcctaaagtgatggtaagaatggttagggtttaattgctcttagaagagcaagtagctttaaataagagacaaaaatatctgcagaaggaaatatgaaagtagaaaacaaaacaattgcattgtcaaaacatgtaagatgttttaatcacctaaaataaaaccagaattgtattataattgctatcctttgtcaaacttttgaaattaaaaaaaaaaaacgctttggaatggtctaaaactacatcataaaaatggctcagccactatctatagagattgacattttttgtttgtgctctgtgtttaggaatttaatgatgtgtattgctgcagattcaatgtaagttcccgatacagataaagatggccaaagctgtaattttttcatccatttcttgaatgatgtatgctaaaattaaagtaatcctaatgttaataataacttttagtgaatgcttgctgtgtgtcaaaaagtatgctagtcactttatatatattggtttatttcatcctttcaaaaacactctttgaaaagtactcttattattcttagtttgcagagaagaaaactgaaggctagagaagttcagaatcttcttttgaaagtagtagagttgtgatgcgaatgcatagcaattactcttgtagatgacctcacaggcttcctcttccaattgtctacgtggctaaaacaaagcaagaaaaccccataagaatctgaaaaagactcatgtaattattaattgacaaataagattatattacattactgataaaccaacaggtagaaaatgaaagcaatgaaatagtatactgcgaaaaaaaatttcatattatattctttgatgaaaaaataaaacaataattgcaaactgcatttcatttttaatgaaacgacaatgtttaattcttctaaaaggtagggagcaaataaaatggttatctggtctttacatcgaatgtgtcatcactactaagtgatattagctggcttattacttaaaattttcttttaggaaaaaagtgtgaaaatagacaggaggagacattaaatggctaaagcaacacccccttgctccgtaagttctttctgagtctgtgtgcctaagattaacaagagagcctgtgagcctcacaaggcaatcacaaagctatgtctacagccttggagagctgtgattacagcagccagcctcctttgcagcacctcagtgatgactacactaactctcactactgagcaacaatgaaatgtttcaaacccaaccaccaacactgttataactcttaaaatttgagccagtcaccatacctgaacgtaaaaagaaaattaccaaaaatgcttgataccaaaaagcaattaatgattcataattgctaatctttattgacagtctcttctagttcttatctacatatattttaattgtctacataatgtaaattaaattttaaattctgatttgtaaacttaatattgcataaatatttatcaatgttgttaaacatcttttaataattattttaacttctttatattatttcattaatttccatctttatgtccttgctggtctgacatttagaaaaaactcctccttttatttagaaaaaaagaatggtgaggccgggcgcggtggctcatacctgtaatcccagcactttgggaggccgaggcaggcagatcacgagatcaggagtttgagaccggcctgaccaacatggtgaaaccctgtctctactaaaaatacaaaaactagcctggcgtggtgctgcatgcctgtagtcccagctacttgggaggctgaggcaggggaatcgcttgaacccgggaggcggaggttgcagtgagccaagatcacgccactgcactccagcctgggtgacagagcaagactctgtctcaaaaatacataaataaggagaataaatggggacaataacaacctattcacagaacagaaataaaaccggagatgtcatgtggaaaaagcttatcttgaaagcgtggtcagagtggaaagaaacagcaacaggagagtcttgatttggtgaaaaaacagaatgcagatggcatagagtatcaacaattaattagcaggccatcaagagacggccataacatattggtaattgttttctttcacccttaattttttctaaaacaaaaacatgaagttagaaagtagttaattttgttagccacatggcttcatggtttaattttatcttctctatgggcctggtacaacaataaagttcttttgagatagaaagacagatgttaggcaaaaacatacaagattttcattctaatcaaaatctttgccaataggctatgacagaatcctatgagagatgatgccatttagaactttcacaagaggcaaaaatagtatgccattggcacctaaaactgccaacagtgatcatcataggatttatttcatttggcggattcttggttgagttcataacctgttccctaggcttttaagattggtccaaacttggcaatggattctttggaaaaattatttcttgatcgttttaaactttcttttccagtgtcaagagagattttcccaggctccgagttttcatttattttttcccctgtcagtttttgaaagagaaatcccctttttgtcggctttgtgattgcttttgtgtcaaattcagcgtaaaagcttttcaaacgtgacagcattagctgttttgtgcttggctgagctaagagtacatgaattcaatagagaagtgaaatcttgtttgagcctggctgatttggctatataatattgaaaactatctgaagcaagaaattcaatacttttcaaattattgaataaacatttctaaggctgcaaaatctctgtgtttttgaaggcattctttaggaaacttgaaacacagacattctataatcacataattaattttaaaagttgaacttattgtatgtagtaactaaggcagctatttgagtgtctcaaattattttactaaaaagggagacatttttcaaatatggaagtagtgccttacatttttagttatctgtggaaggatcgatggcatcatatatctcatccaccataaaaatatgtacggtagtggaaactgaatttttcttttatatattttgtgtattttttggagttgtacaaaattaaatcagcaaattgacccacactagtagtttgaggtttgggtttctggtacaataatgaaaagcattattagaaatcttcttgccaggacctaccatttcttcatgtattttctttattcccttttgttctcccctaaagcttctatgtgattaaagagaaaagatcaataacccaatagtacttttccttctaaagtatgcatgaaactcttaaagttctcaaagcatacaaacagagtgctctctacattgctgatagaacacaggtagtaatgggctagtttccccaggtaactattatattatataaatatttaatgcagagtcaccaagccttgaataactttatgctttgattgtaccatattttctctagtttgcttttcacaatttaacttatcccgtgcttgaaaatataatgtggtaactgtgtaaatctgctcctcaaaaaattttcgaaatcatcttttcttttttcttttctttctttttttcctttttttgagatggagtctcactctgtcacccaggctggagtgcagtggcatgatcttggcttagtgcaacctccacctcctgtgatcaagtgagtctctcagcatcccaagtagatggaactacaggcacattccaccacgcccaactatttctcgtgtttttagtagagacagggtttcactatgttggccaggctggtctcaaactcctgacctcgagtgttccgcccacttcagcctcccaaagtgctgggatacaggcgtgagccaacatgcctggccccacatcgccttttctgaaccctgggaattaaccaaaggctggcaacaatttttgaaatgctgactctcaataaaaatggcaaagtttgaggttttttaagttggcctttcccgtcactttctcccagctccacagtagccttgaaaatcagtagccttgcaaccataatagctgtgaaaactagcagccttttagccaccagagagtgtagaccaggattggaattcttcaaaaaggccaattttattccaagaaccttgccactgtttgacctatcttgcagctccctggaataaacctatatacatggccttgcctttatttggcccgacttagagataactttctaggaaaagccctagctccagggtgttggtccaaaccaattagcagcaattctttaacataacaggttcctaaggctgtgatgctagttgagataaacataggtctggagaaaaacttccagtgaagctctggagaatgaggtgtccataggggattttggcaacctctgacatgttcttgcgggatctagaagcccatgtgcttgtcttaacaaatagagagtatcaataaagagatagaaattgtaaataagaactcagtggaatatctggagttggaaagcacaataactaaaattaaattttcacttgacgtcagattcaagctgcaaaagaaagaatcagcaaacttgaaaataggtaaatgggataatccaatccaaagaaaagaaagaaaaaatattaaggaaatacagaaagcaaaaactgactgaactgaaagaagaattaggtaattcaacaaaaatagttggagacttcaacatctcacttttaataacaggtaaaagaactaggcaaattaacaaggaaatagacacttgaaaaagactataaagactataaacttacaagacctaacagatatctatacagcgtttcatccaataatagcagaatactcattcttttcaactgtacacgaaatattctctagggtaggccatatgctaggtcataaaataagtctcactacattcaaagggattaaaatcatacaatgcagattttatgaccataatggagtacaattaaaaatcagtaacagatgtaaatttgggagttcataaatatgagaaaattatacaacacactcttaaatagccaatgggacaaagaagaaataagaaaatacaaaaatatcttgagataaatggaaataaaaatacaatataccaaaacttatgggaggaggctgaagcagtgcttagagtaaaatgtataactataaatacctatatttaaaaaggaaaaagatctgaaatcagtagcctaagcttctaccttaagaaactagaaaaagaagagaaaagtaaatctacagtaagcagcaggaagtaataacaattagtgtgaaaaaaatcagatagaggaagaaaatataatagaaaaaatcaacaaaaccaaaatctagaaatttagttatttgaaaaggtcaacaaaattgacaaagttttagctgattggttaggaaagaaatggtcaaattactaatattagagaaaaagagggtgcattactaccaacattacagaaataaaaagaagtaaaagaggatattatgaacaactaaacaaatagataacctggatagacctataacaagaaattgaattggtattaaaaacttctcccaatgaaaggctcaggcccagaagtcttcccccgatgaattctaccaaacatataaacaactcttccaaaaaatagaagagaaaggaacacttcctaaccagacaaagatatcacaagaaaacaagctacagagcaatatgccttatgaatatagacttgaaacgcctcaaaaaattatcaaacctaatacaacaacatattaacatgattgctaccataaccaggtaagatttatcacaggaatgtaaggttggtttaacatccaaaatttaatcaatgtattataccatatcaatagaataaaggacaaaaatcgtatggtcatcacaataaatatagaaaattcatgtgacaaagtacaaaaccctttcaagcttgaaaaataaagaacacttaacaaatgaagaatagaaggtattggccaggtgtggtggctcacgcctgtaatcccagcactttgggaggccgaggcagttggatcacgaggtcaggagattgagaccatcctggctaacacggtaaaaccccgtctctgctaaaaatacaaaaaattagctgggcacggtggcgggcgcctgtagtcccagctactcaggaggctgaggcaggagaatggcgcgaaccctggaggcagagtttgcagtgagccgagacagcagcactgcagtccggcctgggcgaaagagcgagactccgtctaaaaaaaaaaaaaaaaagaaggttttgtggattgaatagtgtcccccgctcccaaaagacatactaaaagcctgagcccaggtatctgcaaatgtgaccttatgtagaaatagagtctttgcagatgcagtcaagttaagatggtatttttataagaagaggaaaagaggcatacacagagagaagaatgccacataaaggcactgaccacgggaaaaacaccatgtgatgttacagttagagattaaagtgctacagttgcaagacaagtaaaactaatgattaacggccatcattagaagcaaggaagaggcaaggaaaaattctcccctacaggtttcagcaggagtatgggcctgctggaatcttgattttggatctagcctccagaagtctgagacaatgagttttgtctacccagctacgcaaattgtgacacttaattacagaagcccgaggaaacgaatacagaagaggatttcctcaacctgataaaaggcagctacaaaaattccacagctaatgttattgtgaaacactgaatgctttcccctaagatcaggaaatagtgaaggatgcctggtctcaccacttctattcagtattgtactggaagttcaggccagggaaattaggcaagaaaaataaataaaagacatccagattagaaaggaataagtaaaattatctctacttgcagacaacatgaccttgtaattagaaaattttgaagaatctatgaaaaaatattagaaataataaaataattcagcaaatttgtaggatacaagatcaatatacaaaatgaattattttatacattaaaaatgaataatctaaaagtgaaattaagaaaatatttacaatggcatcaaaaaatgttaaaaacttaggaataaaagagatgcaaggcttgtatactgaagaatacaaagcagtgttgaaagaaattaaagataaaaaaatagaaaaatatcacatgttctcagatcaaaagacttaatattattaagatatcaatatccccccaattgatctacagactctatggaatcattatcaaaatcacaactggcttttttttttttttcagaaattgacaagtggatcctaccatttctattgaaatgcaagggatgtagaatagtcaaaacaaccttgaaaaaagaacaacattggaggagttaactttccaatttcaaaaactactacaaagctacaattattaagtcaatgtggtactagaatgtgaatagacatatagatcaatgaaatagaattgaaagttcaaaagtaaacctttgcatttatggtcaactgatttttgacaagggtaccaagagaattcaatggaaaaagaatagtctttcacaacctggtgctagaataactggatatacacatgaaaaataatgaaatttggccccacctcacaccatacacaaaaattagcttaaatgtatcataaaagaaaacaaataatctgattaaaatgggcaaaacacttaaacatttctcaaaagaagatgtacaaatagctaacgggtttgtgaaaaatgctcaacatcactaatcattggggaaatgcatattacaatcgcagtgagatgtcaccttacacctgttagaatggctgttataaaaagagaagaatgataacaagtgttgatcaaggatatggaaaaaaggtaacacttgtatatcattggtgggaatgtatattagtacaaccattatggagaacagtatggtagctcctcaaaaaactgaaaacagaattaccataggatccagcaatcccacttccgggtatatatccaaaagaatttaaaccagtatgtcaaagagatatcttcactcctgtgtttattgcagcattagtcacaaaagccatgatatggaatcaacctaagtttccatcagtggatgaatggataaagaaaatgtggtacatatacacaatggagtattattcagccttaaataaagaatatccttttgtttatgacagcgtggatgaacctggaggacattatactaaatgaaataagccaggcacagaaagtcaaatactgcgtgatctcacttatgtgtggaatctaaaaaagtcaaactcattgaagtagagagtagaatggtggttaccagaggctgtggatttaggggtggaaaatggggagatgttgatcaaaaggggttaaaaactttagtcaggaggaataagtttttgagactttatgacacaacctggtgaccatagttaataatattatattgtatatttcaaaattgctaaaataacagattttaaatgttcttgctataaaatatgataaatatatgcagtgatagatacgttaaattgctcgatataatcattccacagtgtatacatatatcagaacatacatgtaccccataaatgtatataattatttgtcaaagcaaaataaaattaaaaataaaatgttttaaaacttttgtaaaataaactttataataataatatatttttaatgaatcatagagctaaatatattaataagaactaaaactttaaaactcttctaagaaaatgtaggaatacaatggattatgcagtgttttcttagatatgacaccaaaagcaaaagtaaccgaaaaatacacaatttggactttaacaaaattaaaacttttgtactgcaagcaatattgtaaagaaagggaaaagacaatcctcagaatgggtaaaaatatttgtaaatcatatatttgataagatacttgtatcaagaatatataaaaactcataattcaacaacaaaaaggataaatgacttaattacaagtgaagaaacagtttgaataggcatttctccaaagtagatgtatagatctccataagcacatgaaaagatggttaacatcattgattgtttaaaaaatgcaaatgaaaaccacaaggagatagtactttttacccactaggatggctaatacaaaaaatacagacaataacaagtgttgagaagatgaagaatgcttggaattttcacattactggtggaaatgtaaaatggtgaaacaactttgaaaacagtttggaagttcctggaaatatttttttaatttttaatttttgtgggtacacagtaggtatatatatttatgggatacaggaaatattttgatataggcatacaatgtgtaacagtcacattggggtacctggcctatccctcacctcaagcaattatcttttctgttacaaacgacaatctaataataatcagttatttttaaattcacaataaattttttgactgtagtcatcctcttgtgctatcaaatactagatcttattcattctatcaaactatatttttgtattataaatttcactacccattagccatccccccctttccccctaccactacccttcccagtctcctggaaatattaaacatgaagctaccatatgacaaaaccattctactcccaggtgtatgctgaacagaaataaaaatacatatgtacacagaaaacctttatacagatgttcatagcagcattatttataatagccaaaaagtagaaccaacccaaatgtccatcagctaatgaataaattttaaaatgtcctctacatccaaaaatggaatattatttagcaataaaaagaaatgaaatactgatatgcactgtaacatgagtgaacctcaaaaatatgctaagtgatggaatccagtcacaaaagaccccaaattgtatcaatacattcatataaaacatccagtaaagactgaaggaggaggagaatagacaatagaaagggactgttaattggtatgggtttcattgggggcaaataaaatgttctcaaattagatcataataatggttgcacaaccctgaatacattaagaaccagaaaattatgcactttaagtgggagaattttatggtatgttaaaaagtatatctgcatgtcattgactacagatcttttcttattttttcaagttttatgaacacagttttagaaacatagtctccatttttctctttcatgaagctgcttgccagctatagaaatgaaaaaatagccatgtctgtggaacataactgctacctagatgggagcctccatcacacaatggatagggagctattttcttttatggtcaagataggcaggttctgtcctatagaatatattctgagatgttacctgtagttcagaaaaacagggatattgttgttctaaacatttcctcaacatttatgtggcttcctatttattaataagagaacctgttctttatgtgtcattatactagtttattctagccctggtcctggtccaggactgtctggaggtattagaattgccctactctatgtgaaataaggtcatatctgaataggtatgtcagtcagcataggctaagctacagtaataagcaacctcaaatctagaggcttaatagtctatattttactcatgttacatgttcgttgtagactgatgagagcattctacttagcttagtcactcggggaccatggctgatggtatctccatcttggtacattctttcatgatcatagaggcaaggaacatggttcttgagccttctgcctggaagtgaccagtagacaaaaccagtcacatggccattcctgagttcaatgggaatgccgatgtataatcttctggcgtgaaaaggcactggatatttgagaacaataatgcagtctaccacaatatgctcatggggtctgaaaaggagctgaaaaaacgccattttctggggttctgtcctctggcattgtttctggaatcgtttccacccatccatttctacaccctctcaactgacttttctcagatgcctggggtagctgggtgatttgttaattacagtattgcttaagccttttaataaagtcagcaaattaaagagagagcccagataaagagaatgctttcaaaaatgtcataatgaaattaaggtaacgaagcacttggagacctctcctcccttctttttgtatgaaacttattccaaagcagctggaagagaaatggggcctgaaagtaaagaggggaaaaatatattgtatgccattagtttaattataaaaattcattacatgaagccatgtaagacagaaaataatggaactctaatgggttggccgataacacatttactagtctgctctcagcttgtagtcattgttgaaaggacagaaaagtaacgacgttggtatgtagtcttcaaagctattgtaaagattaatcattttcagtaagccggaaaatgagggccattttcttaaatagtatgccctgtatagagtgttaccttctgaaacagagttgtttggtaatgtcagaggtttaatagatgagtcttgaagttaatggtgagaggctttacttttgaaatggctttcttacagctattttaacatttctattataaatccataaagaggttttataggtcgttttaattcacacaaggagggaagaaattgtgcttctcttttcccaataaggatttatagaacattaattcattcttgggaccaaattgtttagtgattttcaaaaataaactatgtatttttctgctgtctttttttcagaaatgccttactttattatacataataattttccagtcatgctataatcatcaagattgttttatattcttcaaagctcagttaaaataaacccagtccttttccttaaatttctttatatggatgcataacttctttaactgaattgaaatgaaacctgaattgagagtccagaaacctgcatttttatgatgactctttcactgactagctatgtcaccttgaacaagtcacttaacctttcagagcatttatattctcatgtggacaattatggaattgctcaaaaaggaagaagatatcaaaagatgaaagtgaatatgtaggtaggggtcatatattcgagggccttgtaatccaaagagagaggttaggactttgtcttgcaggtaatagcaaaccattgaaaggttttacacagaggagaaatgaggttctatttgcattacaaaaagatcatttacgcagttgtatgtaggtggaagggtggtttgagagtggagggagggagccaataaaaaagattattttagtacctgagcaagagatgatagggacgtaaattaaggtagtgtcaatggaagtagaagatttggataaaagttaaaaaaaaaaaaaaaaaaacttatgatacaactacccagggagtatgttccctgcctcctgctccagttgaggaccaacatatcagattgatccagagacagaattttggagaacattaatatttaaaggacaggcaaaaaaaaaaaaaaaaaagcttgaacactcagagaatacagaggcgaccaaaagagtggaagccaagaaagcagagaacttcgagaagagaatagtcagcagcaccagttgctgcaaataaatcaagtaaataagaacttaaatctttccataggcattggcttttggtaactgaatcagttaactattttcacaaatgtgagtggcatatagcaataagcccatattgcctttcatgaattttcagcttgggtggggtggcacttcttcatgttgcaggttgattggggtcgctctgctccatatgtcactcattctcctcctgagatgagtaggctagtccagagcatgtttgtcttaaggtaatggtgaagtgcaaaagggatagccacactgcataaatacatttcaagcctctgcttgtgttacttctagtaatatcccactgggattaggcaaagcaaggcgcatgaccaagctcaatgtcaagggcatgctgtctttcgtaggaagaatttcagagttacttagcaaagggcatggatacagggagaggtaaagaattggggccagtaattcaatttgccatagtgacttctgtcagaatagttttagtggaacgatgatggcagaagcctgattttcatgaattggagagtggcacgaatgtagtcaagttgagataatgagtgaatatctgccttctaaagagtgtgactgtgaaaggaaagaaaatgatagagtgcagattattgttgttgttgttgtttaaagatgagagagacactcatgtttgaagtctctagagaaggtccccgcagagaggcaagaagttggaacacacaaagagagagggagtatgtggaggaggatcccagaatagatgggtgcccagatggtgaaatcaacttccaatagcagaaaagtcgcctcttcctctgagactagagagaaggatgcaagatgtaaagtctgatatttcatgaaatgtatgtttgatatattaaatttccccctgtggaattgtaggtaggatcatttactgtgagatttctttcagttcgtgttgtcaggaattagtctgtaaaccacattcgatatttcaaacagaggaaattcaatacagaggactggctcctccataggaatgaaggagctgacaaacccaacagaggacagtgaggcaacccagagtttagcaacttcaggaaactattaccacctcaagggctggggaaccgacaagttttaccaaagcccagaaaccagaaccatcgggtgctaattcacccaatgtaaggtctgcacagcaggtaatggaattacagagggagcagccgtccagtgggaaacggagacaaaggagatactgccaagacagagagagaagggggataattatcttgtttcaccctttctcatgctcttctgtctcccactagtgtgtctcatgacttaacctagttagaagccagctagcaagaaatcccaggaaattctgacctcctatgggagttagtacatctcaatactgagtggagtaggaaatgggtagagaatggatctaagagcaaacgacctcttggtggttagctaacagagttaaatttttccatgaatcccttggttcatgaatgtaaatacaggatccaaggaaaaataacaaatccaacatgtagaactttttgttcataagcatattaggatcctgttttacaattttccgagcaattgcttgattttgacacttcaggacaagccggaggcatggtcagagcaagtaaccccatcctagtttacagatgacaaaactgggacttacaaggttaatgacttccttaagatcaaactgcagaacaatggacaagcaaaacttcctgggaagatgtcctttcgttactctgcactgcctttcttgaagttcctttgagacacagtcattaaaaatttaagtaatagttcacccggaacaaacatttattttacttgtaggtgaatatcacaaaacacattttaaaaggaaatttaaccaatattcaaccttaaaattttaatgatagagctatgcacttgcttttatcttccaagttaaagggagaattttagagttgcagcatttctagacaatgtccataaaacagcgagctacttgctttgcattcagaaggggctcacactgtggggaatatagtttgactcattaaaattagtagtagatgtgctagcagtagtaatgatgatgatgatgctgatgctgatgatgattaatatttatttaatccttcgggcacgccaggcacctttgtaaatgttctccctgaattctctaagttaacccacctaatcatatttccacataaatactgttaatattcccatttagcaaaggaggaaactgaggcacagaaaagataattaactctcccatttgccactaagcgatcacgccaggattcaaacccagcaggctcattgtattgctcaggcttttagctactctttctcttcctcctctcttttctaccatgtagggtcaatatcactaaaataagttcttacacataaaagaaatgagagaagacaaacaattaaagtagaaaaaaatactcaaaattcttgaaattaattcaggttgtctcatagtccacaatcactttttctacctaagatactgtgaatatatatcaagcacatagtgcagtagcagcataatgggtttgaatgtgaaacatttctttcctggttggggaaacaatcttttggggatttagcattttatattcttcatagaaaacacacacacatacacacacacacacatacacacacacacatatacaaaggcaatctttttttataagctagtgctcacagtattttaaatttcttcacacaccatgatcaccacacaagcaattccctgtggtgtacaccattgtcaatggaattcagaaagagaaaagggtgtgtgtgaagtctgttgtatttttgaatttacactccttctgaggtctggagttatcccagtagtaaatttcacagcagtaggcaaagctggtcaaggtcatggttcctagtgtgaatgacacttgggtaaaacccaaggtgggcgggcagaatattaccgtaggagaaagggaaaacattctgtgtggggaatgtctttaagaagggagaaaaaaaaaaaaggctacctttgagaacctttgtgtttatataagggcctgagccccctcaatgtcagtcaaggtcagtgggagttttactttttaatcctacatcctcacaaaacctgggcagtattcagtgagggttagcactcagtcaagatttccttaggtataacagtcctaactttcgctgtgaatacaattttgcagaaaaatatatggcacgcgtatttctacctttcaagcattaaagtacatcaaaaagttctggtttgacgtcaagcctcactctttactaccttgtttagtaggaaatctgtcatttaactctagcttactatttctttcagagattttggaaaattctaggatatgttataatttataattttaggcatttttatgatctattgattatgtttttagattcattggcaccttctgcattttatgttttttaattttaacagctttattgaagtgtaattgatatacaaaaactgcataaaattatatgggctagaacatgtgcatatacccatgaaaccatccaaatggtataacctcttatatctagacttttcaaacaggaacctatgagtgatgggtggcttccaaggttatttaacttgcttgagtaaaataaatgattttaattatatatttactaaaaattttgtttttattttgtattcctgagcttttacatatatgctctgatactggtccatcataagtattttattaacaattcagtgttttataaaaggaattcatttgaaaaaaaggtaaccaagttattggtctcagttttgtggatgttcatgctattaattagcaatttaatagatgagagataataagctcttcttttaaaatgcaaatagcaccctctggatactaagggccaattacatgttctttcgtatcttggaatacatttcttttatcactttaggtttggcttaagtgaggaggagaaagaaagaagtggtaattttgtaccctaggatatttctagaaaaggcaagcctttggcagaagttccctcagaagggctttcaaatagtgcgaggatctgaaaagtggagaatagaaactgtaatgcttgataaaaggagtatggaagaaaaggcaggcattccacgcggataaatgttaattgttttgtaatagcagcaactatgctctgtgcctttagacactgtcctctgctttcatagcaaaagtcagtgatattggcattagcttcttgataatagtttggtaatctgggtctatttgctatatgcagtaaatactattacttggtttgattctaggatgttttagttaactgagaaattacattatatatagattgtatatgttcaataggagttcaccaaacacgctgaaattatgctaagaacactgtttgatttttattctgtaaatatcatactaacgcaaaagaacaaatattaaaacaaaaatgatttttctcctcagaagcattattttcaatttcttccatttcgtgttcagctcatgattatgtattcttagagataaacacagtgtagttaaaaattgtgttctgttttttacacaagaaaattgtgctctttttacagtgattactgtgcacatttgctacatattggaccattggaatgatgtattatgttcttttaatgtccctgcattaaacatcgacattgtttctctttttttttttttttttttttttttttttccgagatggagtctcactctgtcgcccaggctggagtgcagtggcgtgatcttggctcactgcaacttccatctcctgggttcaagcaattctctgcctcagcctcccgagtagctgggattacaggagcctaccagcacacccggctaatttttatatttttagtagagacggtgtttcaccatcttggccagactggtcttgaactcctgacctcgtgatccacccgccttggcctccctaagtgctgggattacaggcatgagccaccgcacccggcctgtttctcatttttttactgctttggttaatgaagattttaagtcatatagtatattgatcttcttttgaagattttatcaggataaagtaccaaaagtgagattattgagtcaatgggaataagcatttgtatgtcacttggtatctattgccaaattgtcctaatagataacggtccccagcagtaatacgtgaatgtgctagttttactggtcttttcagctttggattttattttttgttaatttaattggtgtccaattgtaccttttcaatttaatactctattttttattacttgaaagttaacttttttctttttaaataaaatcatcccactctttctcttgtttgaactacctgttcctattcctgtgtccatttatcaatgacttaacccatcctattgaatttgatataactatcttaacaattagtattatcttaatgcttagaagcctcctctctgcacttgcagaaatgtttaatagaaatttcaggttgatatgcttcgagataaaacctaccattaattgacttctttctttgaaatatgtttcaagtgatgagatagcaagtttgaaaacactgaattgccaaagacaaacaacgaagaaaatgtaggtgatttggtttagtaagattcttatattttgactttttttctaattttaaagtaaggtattctaaaagtattttgatccttcaaaaaattcgtgactagaataacagtactattcttttgttgttcaatattttctgtatgcaggtttagttgaacgccagtagatggcactaattacataaacaattcaacaagttaatgaagagggaaagaaatgtatgaggtttttttcgttcaaatgttgttatatgtcacatattcaacaattatatatgagcttatttttgtagtttttttctcttgtgataaaaacaattaagcccactttattgccaattaattgctactaagttgaaatacttgatactggttattgctcaagatgctgcatttgaaaagtttgtcctgaaaggtgggttaccttatactgtcatgattgactaaatcatatggtaggttaaaagcaatctaatatatgtattctgacctgaggattcagaagctgtttacgaagtattttaagacactccaactagagatttcataaaaaaaactgacattcattctctttctcataaaaatctatagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaaggtatgaattacattatttctaaaactactgttggctgtaataatggggtggtgaaactggatggaccatgaggatttgtttttccaatccagctaaactggagcttgggagggttcaagacgataaataccaactaaactcacggacttggctcagacttctattttaaaaacgaggaacataagatctcatttgcccgctgtcacaaaagtagtgacataaccaagagattaaacaaaaagcaaaatactgatttatagctagaagagccatttatcagtctactttgataactctatccaaaggaatatctttctatctcatcatggcgcacactgccttacctgttatctgataaataagtcactttgggattcatgatagagttatagctgtacatggtctcatcctagtatctcactccacacacccaatgggaaaatttgtggagggcaatatgactcgtcacttcatttcccattatatatgaatggaaattaacagcgcttatagacagtatctcctcaaactaagccttgtatccttattatacctctcttgatctctagtgcttttttcactagcatttattccaatcataaataaaaatataaattatgtaactaattgttaaatatttgtcctttaaattaatctaaatgccatgagggcagagattttgtctttctcatttgatacatccccaggtcctgaaccacgtgatataatagggagctagtaaatgttttttgaatgatgactccctttgcagaatgtacaattaccttgtgcaagctgaaaaaatagcacctgtacaatatgaggaagaccacggtgaaaaataattgagttccaaaatatgacatcaattactgaaaaaataagctcggtgatttttaacaagaagtaaaagtcaccactggggccaaaacagattttgaactaagagtaggaagtcttaggagaaatgagataatgatatatggaaattaagcggccaactaaattttgaaactgagctagacattagagagtaaaaactcctgtgaagctgaatttaagctggtcaccctggggaatagagcaactctaatcctgaattccagacagtaggtgtatagatggaaaagaccatggaaaagaagattcaacctaaagttgggaagttttaattggagccctatgaaaaagaccctggtggagaaagggcaaacttgaatatggagctgatatttggaaaaattctcatagtaactactttttctcaatggcaaggcttggactttcttctcaaaatacagatcttatatgtgttcaattaaacagggacagattaggttcaggaagaattattcacatggaatcaattggtatcagagagtcaaccattagatcttagtgggaaatatctgcttctcaaagagaagtcttttggggaaagcaaattaaagtcagagattaatttgatgagtttaggtaatataaactaaggggccaagaaaaaagcttgctcatggtatgaaactagagcttgaggacactgatctagtctatctatactactctttctgacagacccctctcttcattctcatgctccttgatggcccaagccactctctcagttttttaaaaaattgttttatcaaggtctctggattcttcatgggaatgacttccagtttatattttttggcttggttccaaaaagctatcagctaaggaatgcatatacttacttcccctatgggtaaagtaaatgagaattttagaagccaactcacatttttagcctgtacagaatctgcaattcaccaagctacttctgactcatgtctataaagttcttccctgttcttttctcacttcacatgtactctttgcaagaattcatccacttgtgtagtttcagtctgttgatgactacccatctataattccagctgagaatgatcttttgagttttagacatgtagatcctgctgctttctttcgatgttaatgtcccacaggaacttcacattgaagaggtccaaagctaaactcatctttgccttcttccaatctctttctccaaatgcaacctacttctgttgtccttgtcttagtccttttcgtgcttccgtaacaaaataccacagactgggtaatttataatgaacagggatttgttggctcatagttctggaggctgcgaagtccaagatcaaggggctggaatctggtaagggccttcttgttgtgtcatgattccatgatggaaggtggaagaccaaaagagagaaaaaatggggccaaacttgtccttatatgaaactcactcccacaataatgatgctaatccgttcatgaaggcagagccttcatgtcctaatcacctcttcaaggtcacatttactactgttgcaatggcaattaaattttaccataagtttgggaagggaaaaacattaaaccatagcattctgcccccttttccccaaaattcttgttcttctcaaagacaaaatacattcatttcatccccaaagccccaaaaatcttatttcagcataaactcaaaagtgcaatctaatataaattagatatgggtgagactcaaggcacaattcatcgtgaggcaaattcccttccatctctgagcctgcaaaatcgaatcaagttcatcccctcaccccctacccttcccagcatcaggtaaccaccaatcacagaaagttttactgatagtcctgctctagatcatctttgtctatgttcactttagctatttatcctagtgttccattattggaatactaagcatgtgggaattatttatattctactgttcaaggtcctcaccaaggtctgattgcaaaaattcaaaaaattgcaaccttaggcataaatgggttaagcagtttagggtacatttataataattatttactgtgctacttcaaaaatcttattgcctctatttataaataaaaagtgttgtctctacacagtggcttgttgtaatgcatttacttgtttctgcctgattttttctatttatacattttcttttttatttttatttttattttttcacttttaagttcaggggtacatgtgcaggtttgttacataggtaaacttgtgtcatgggggtctgttgtacagattatttcatcacctaggtattaatcctggtacccgttagttgactttcctgatcctctcgctcctcccaccctccacactctaatagtccctagcatgtgttgttcccctctacgtgtccatgtgttctcatcatttagctcccacttataaatgagaacatggggtatttggttttttgttcctgtattagtttgataaggacaatggcctccagatccatctatgtccctgcaaaggacatgatctcattctttttttatggctacgtagtattccatggtatttgtgttggtctcaaaaactacaactatgacaggatggcattttcacttttgttgttatattaaactcatcttaaaaaggaaagattaataatgtcaatatttgggttatggagaaaaagtatctcatatctttgaaaaagttctgtaactatagctttttaggtaggagggattctgtggaaagttttctgattacatcatttctcacagttcaggttagacaccattttactatgaaacactaatgcattgcctgcactgagactttcagtcacatggagaaacctaggcaaaatttttgtacacttggaagaatatttaaattagtaataaaatctttagttttaaactgttgaatgttaaataagatataaaatgtacttgaaagaaatttgctttgatatcagacactgccatgttgcagtttcaagacataataaaaaagtaaactaatgtttatattttgctgtttaagtttattaatacatcagatgagtcttcaaattctacagtggcttttgatatgatcatttttacttgccattttatatagaataaatataaataggcatttatgcttaaaaggaactaatctatctatggaaaaaagagaaggctgcttctcaactaaattgtacagtttagaaacccagatctgaacatagattattgttgtgacctatgtaggaaaatatgttgttttccttatcgtagtccttacagagtccatgataacatataaagccagaaatgtgagcctctgcaagttcatttctttgtcttcaatctctgtgaatagatatgagtttgtgaataagataatattagatgtgatattacaaattattgtgagaagcctctaaggattagatttcaaggactgccatctggctgatgactttatgatgacactgtcatgagatttcatttccttatttctgttccaggatcactctttaaacaagaaataagcattaactctgaattgtctgcttgtagctgtatgagggcttccacaactgccaactagccaggtacaaactcatcaagcagaggagatggtccttgcatcagagggttaaacatgcctagaagttccttagctaagctcccagatactaaaaaatccctctaggttctaagaaagattcagcatgtacatgtgtgtacatgtatgtgtgtacatatatacatatacgtgtatatgcatatgcatgcatatacatacaaacacattttcttccataacatctcagtattctctgttctttataatactgttttgtattttaatgatcaaaattaatagttgatcatctgaaaacattttgacctgttttctccgtctttgacaaccttgaaggcacttgtaagtcactctttgcttctctattcctaggtcctttctcatcttcattgcaacaagaaaagagaaaacaattgagccctattttgtgtgtagcaaggagctactctagttaaacactagatctcttttacattctccaacatgttgttttagtaattattctactttcctttttttgggatattcaatttcttctttctttttgctcctcccctttagcaggccaacatactcaagtctccctcatcctaagagaacttttttagtatatcattttttttctatccagctgtacttgcttctgcttactatatcatttttaagcagtagttggcattactgtttcctgttctttagctactagttgtactttgacccactccagtctcacttccccagcaccaccactttatgaaaacaaggacttactaagatcatcagtgactttgtaatagctaattagtgtattttaattcgtccatcttcttgactatattttaacattgatcctgttggtcaactctgctaatcaaaactttatcctccttggttcccagaacaatattatcttgaatatctcatttctctaatcatataataattgtgaggtgcttggcacaatgcctagtgcgtagtaagaactcagtaaaatatcatctgccatcgacaccataaaaattaatttacttactcaacaaatacttttgtatgaagtttgtgctaggtaggcccagtaattggtacttggtatagagcaatgaaaagccctaccctcataaagcttatattcttggaagcagaagttggaagacagacattgacaaataaaaattaaatacatgatgtgtcagatggtcatacacacagtgtggaagaacaaagaggaaaacaagtggagagagagagggaggtggaagaggagtgctgccatgaaaatgtggtaatcaaaaaaggtcttactgaaaaggtggcatttaagcaaattctaaaagacctgaggatgtgggccatatgtataattgggggggaaaaagtagtccaggagagtcctaataagttaaaatgccccaaagcaggaatattcttggcatgttgaaggaaccttaaaagggagatcagttaggcagaaaaggatcaagcgagcaggaaggtagttgacaataaatttagaggggtaactggcatctgattatattggccttttaggcctgtggactttagcttttaatctgaatgagatgggagttattggagggttttgaatggaggagtgacatgttttgtcttatctggctcctctgttacaatagactaaacagaagtagtgagaccattaggaaactgttgtcataattcagtcaagagatgactgtggctgggatcagaatgggagaggtgaatgtggtgaggagtggttggattctactatattttgggtacagagcacaacagattttataatggaataaatttaggtgtgagagaaagagtcaagaagactcaagaatttttagcctgagcaacggaaagatggggtcatcatttactgagatggggaaggctccaggagtaacatattttgggaggaagatgtggatatgttacatttgaaatgcctattatacatctaggagatgtgtggagtagatagctggatatatgaatcttaagttatggggagtagctcaagatacaaagttgggagttgtaacaatgatcagtgcaagttctctgtcttcaatgcaattttaaatgttgatgttccattcttaattgtctctcttctttctctctgcacattttgagtagctttgtctgttggcttcagttaacattaagactcctcagtgtcaacttccatcttacactcttctcctgatctccagaactgtactttctgccacctaacctacattaccacctggatatgctacaggctgcaaaatgtgtcaagtagaatgcattatcttgcccctaaaagaaagttaaattttctgtgttttcagtgtagtgtaattgtctaacttaattgtctctaaaactggaaacctaagaattaccttctacctttctcttgatctctctttcccaatctactgacacatgtattaaactggcttccaaattctgtgaattctacttcaaaaattgctctagaaacaattccctctctttatccctattgtcacctcatcctaaagcctcttcatcctttgtagatttctgggagattgtaaccaacttttctctattctgccagttatcaagtctttacgctcatttgacattcacaacagccttggatctgtcttccttgaaatgaatcttcttgcttccctttgattccagtgctttttttttaccctcctgagacttgatgcatgatatttacatgtatgacatgtttccaaaagcattctcaaatttttctgaaagtaaaaacaaatgaaaaagtaaaacattttcctgggaagaaaagcaaatagtgttatacatttttgcttgttcatttgtttgtttatttaggagagggacaagcattagaacttcataagagtcttatatgctgtatctacaaataccgtcccttggcaatataattttagagttccttttctggaactacttaaggactgttttatgatcctcagcagactgttatattattttatagccataccttttatttgctgagtaattgtactcaataattgtttgtaattgaatgaaacaattcatcagatgttgggcactgaatggctttggattatttccaaaaatttaaaggataaagatttgctgccttcaaagctatgtacaaaaatatgatagaatgctagcgggatatttgtttaaaatacaacctttattacattggggcctgctcataatatatatgtggcacattttatttaaaatattaaagttcctggtgggacatgtccccataatcccagcactttgggaggccgaggtgggggtgggaggatcactagaggccaagagtttgagaccagcctgggcaacatagtgagataccatttctacaaaacataaaaaaaaaaaaaaaaaagccaagtttgtagtcccagctacttgggaagctgaggcaagaggatttcttgaacctaggagttcagttcaaggctgcagtgagctatgatcatgccagtgtactccagcctgggtgacgtagtgagactccatctcttaaaattaaattaaatttaaagctacaaatgaccccaaagccaccagttcaaccctctcaattttgaataccctattttaaattcctcttatgcgaaatgtaccttgtagtccattttaaggactgagaggatttggtatgttaaaaaattcaatccattatcaactcctttaggtacacttagcagtatgaaaatgtgtctttcggctcttcaggagagagtcatatgtatagttacaagacaatcccatttttatattgctgagacccaaatcttcccaactgattatgaagcataagaactcttcggaggtttaagtgagctgagattgtgccactgcactacagcctgggcgacagagcaagactttgtctcaaaaaaaaaaaaaaattctctgcattctacagtagggtaatataacatctatgatgtgaaatcttggggctccgggccagagagtgtcatgatccatatggatctaaaaggttcatagtggtaacagcctgcttcattttatgtcatctcctttcaagtaattagaatgtttctagcttgcagggattgcacacaaagggagacatttggaaccatgtcattggtgatttactggtgtggaaaattacctggtgatgtagccaagtagccattttcattctaacccagtcctacagtcctgaactgggctgaaccaacgcaccaaaatatatgcttagaaatgctcctatgtatcagttttcccaggaaaaacaatagtattatcgaaaacttaccattgtttcctaataaaaaattataggataccaacagactgttttttgttcataaatttaatattacagtatcaaatattaaagcaaatgggagaaagtttttcttatttggtttaattgaaccattaatgttagctacaatacccatcatgttacttttcaattatatttatattttcattttatttctatctgtatcattctcagaaagacttctttaaaacattcaataaaaatagaatttaggtagatttatttttagaaagttgagtttttttaataaatgaatataatcatcacttgacttaatttttttctgcacaattctagaaatcttatagttttgggatcctttggctttattcagtatgtaacagggatctgtttcctttctctaaatcattaattcaaatgatttcttatattaaaaatgtttggacatataggtattaatgagttttatgaaatctaatctttccaatttccccctaaaaagggatgtcatttaatcagttctaggttgtgatcaatagcagatttttttttttttttttttttttttttttttttttttttttttttttgcagctccctttcaccccgtagggaaacctgatatcatccttgactaattgcagcaaagagcctggctcaggtcctttgtcttataccgagtgtttatagattcttgagcccagcagaatctgaactcctggctactgctacctacttcccagcccaggccccaaaagccctatgtctgcagccccgtgcaccactgtgtgtttttgtggcatttctgaaacacagagctacttaacttgtttctaagcccagattgtgcctttttgattttctattttggtattttatctaccatttttctgtgtttggatgtttcttctatattttgaaataacttctttcctttagtacaagtgattcttattgtagaaactatcaaaaatttacaaataaagaatcattctcaacattcttagcaattccttctatcatatttttgcaaatatatttttgcctatttttattttacttactccctgtttattaacagttaaaagcattttcagatagttttattttttcatttaaaaaaatcttaccacatttttattaggaaggaaatggacaggtgtttatcttttcaataaaaaacatgggggaaataatttcttgaagtacatagtgacattcttccagccaatgttttatgctgtggtcattccgtctgtcatcagtattcatagaaagagatgaaaattatttaaattaactaggaaatcaattccccattcaaagcagtagttgtgtgtttcaaatatcttctaatagtcagtttcacacttagctttatcaaattcctaattatgatactcattacatcactctgtgtccagtcagtgtgtttatgccacagagcaattaaagcaaatcaggtgaaccaaattcaatcacctttgtagataataacctacgttgcttaaacttatggccgctcatacaattactgatggattgcctttttcttttatattgccagtattttaaatgtcctagtgaagttggggtagctgttgaacttcaactttatcacaacctcttttttaaaatgtgtaaacgaaaaaaccctccatgaaatgaccaaatacagttttcatgctgggacaaattagatgaataataatcataaattcataatgattatttatgattttatgtttttatagtgagatatgttttgttgaaatgtgttatataagtgatacttaagtttcctattaaaatagaaatgctaaaatggcattgttctctttagctgtgagtctagcttttgacctctgcttaaacggaactgttgttccatcccaaatctgcaactctgaggcctatgctcccttcactgctgtctaatggatacctatcaatttggaaggaggtttcaggcagctattcccggtaatctaatctcagctctgtccttttcaatattttcatcagtggcttggatgaagacatagataacattcttatcaaatcaatgccacaaagcagggagaaatagcaaatatagcagacaagagtatcaggagccaaaaagttttcaacaagttggactggtaggctgaatactgaaagatgtaatgtaaatgcaaggtgctacatgtgggttcaaaagaaacatgaaacaaaaaacccatctaacttagactgggctccctggaaatagactaagatagagagttgtgtgcataaggtttgttgaggagtgttcccatgagatacatgtgtaaggttgtaagataggcaagattgcacagacgaagaagtgcagtgaagcctgcagtgcgttgcggcctcatcagattttcaggggagttctggaaattgcatggccctttagagacacgctgaattgaagcaagggatctggacctttgaacccaatactagagagttaatggtcctgggtcaccccatgggaaagagcagactggagtaagattgttacctacagctgaaggcaatttccagggagggaggcagctgtgagctgttagtagtcaatattccaaccagctagggcatgaggtcttggcagagcaacagtgtacccaagaccgcagtgttacccaaagtatggtcctctgactggcagcattggtatcacctatgagctcactagaaatttaaatttgtaggtcctaccccatccaactaaatcagaatctctggggatgggacttggggaacttttaacaagctttcaggcctccaagttatttctatgcatattaaaatttgagaaccactgcctacaccaaccaaaaacattccaaatatggagataacatagagtttttagcaacaataatctccttctgtttcacttctctctttacacacacacacacacacacacacacacaacacacaacacacaatgtgatagaacagtgggaaaggaaagccaaaggggatcttaggccgaataaatttaagcatataacctagtcctaagaacgtatatttcagcttaatagagagaggaatattgttataaagctgtccaaagatggaacaggctgccttgtaaagttgtagaagtattcaggaacaggttggtgataccttggtggttgtatggtataacatcctgatcttcacatactcatcatctagagtgggagttttctttttccaaatggggttttggcagaactagttccactgtatcttaataagtaataactcaagaaagggttctatggatgaaaaaatgattaggtaatatcaagttaaatcaaagcgaacagacttctttcccataggagtaatcagacccttattacagtgcatgcttggtgaatcaacaaagtatgtgtatttatgaaagtatggggggaagggataatctatacagtatgcatcccttctaaaagtttgaccatgaaaacaatttctcaagaatcttatacaacactacagtatctggtccaatactatgcatagaacatgcactcagtaagtgtttgtaagatagatagcatagcatataggccaggccactgaagggaaatcatctcaccgtgagttacctgaatagtattctctagtgccattagctcaattcttcacgtaggcataagcctatacatttgccatgctaaccaagggaatttgtgttacgtgaattttgactctattcagacatttttttctatgactcctccaaggctgttattcttacctcatattctggtagaagtttaaggacttttttctgggaatattgattaattagctagctagctagagacagagagaggatagagattgattctctggcagagcctatttgaatcatattgaatctttttttttcctgagacttcccacaaggaggatggaggagaaattttttagaaatccaccgaagtaatcagggatatcttcagtaaaagaagctatacttaataaagtctctattttagcagatggcaatcaacaatagaggcaatagacaatagagtctattaaaattgctgggatctgctaataacgtttttcttttccctgaaacaaatgccattaaccctccttgacactctgtcttcatcaacattctaatagaatggaagtaactcataattttgaggatttttttcccacacaaaacctataaaccacaccacgctagtgattacttttagcctagttgctaggttgctgctggtaacagtaaaacttatcctgacaggtaggcaattccagaagcccagccaagcacttggtgtgtgtgagtaaacccccatacacttctcatgtagagtaaccctggccaacccataactcttagcaactattcctggtggacggacctggtctactctaagaagaggccaaggttctttaatagtgcagttgcaagaaccagaattgaaagtcaaagttctagcaagattttgcagactccttggcaaaccagtggcttgggactcattcttgacttcaagcccttaattgataatggtaggacagcttgcttgcgctgggttctgctccctgggatatgcactgtttgccaaatgagtagcaggtggacagacatctttacaatttgctgtcccatattctaaatgaacgtgacattctataggtctgagttaacctatgaagtcaccaatttcaatatcaaaatatttatgacagagaaaaggatactgaggcacagagagtctgtgactttcctaagctcaaaacaccagtttgtgttaattctgacacagaaattcttgtatttgctatcagtctcctttttctgtgtgtgtgtgtgtttttacattgcagcatcacctatatgatgttaggttctgtaactttttgagaattttctcacatacagtgatgtgttactttttgatatttcaaatagttctagtaagtcttttctacttttattagcgtattaacatactggctctaagagggcatctcaccacatctttgccattcttcctggaaaggcaagtttctctccatcttcttttttgtattccaaagttttgccaaagtttgcttttgaaaatgggttacctggcagagctttattattctaactttgaaagtacaagtcagaatcagacagtggcagttatatatgcactactgtgattactatataatgaaagtatctatggtgaaaatactgatactgacatatatttgccattttctaattaagtgcttcagtaaaaattaagcactcactctttgccagatactgcaatagatattgagcacattgaacaaaattctccatatacatatatatgagtccacattctatgaaagtataatgtttttctgagaaaaggcataatattctattaatatcagcttttgcttcttccaccatatattgaaagaattctgaatactgttataatttaatgggagaatctagagaattctgtatttgctttcactgcattgatgaactaagatttttaaaaaatgtattcttcatagaactacttttccatatttacctaatattattcttatatcatttgagcacatatttcactaacaaaacaaatgtgcaatgttattagttctaacatcaaaattacactgatactttaatttttatcctattatttttcatgcagattaaaataattatagctacatcacatgttgcaagttttaagagctactttaaaaatatatgcttcaggaaagacatgattagatggggaaatggatgatgttcatattttcaaatgaaaagttttaaaaaagtgcctatcacaaacactaaatttttacataaattatcaactactaatatatctacaagaaataccatttttccctacaaaaactcttaacaataattgttaaacttagtcctggaacctgctaatataatcggacaaatgttgtcaataagaaggtgaaaaagaaagcatatatagtttatcaaactataaaatatagtttatcaaaaccaatttttcctattgacatttattcaggaaggaaaatggatgagtgaaatgaacaatggtctctaagagaggtgggagatagcaataaattcagaccacgtttcctgtcattacagcagggaagtaaaagagctacagtcaactctcgaaagtacttgggggaactaatgattccctgtagacctgtgatgtttttgaaatttaattcaacaatttgatatacaccgcaaagcgaacagatagtcagatcaaaatcggaagaacgattgtctgaatggcatccatttttcctagatgtgctgtcccatcctgtgtcaattaaactttcaggtgatcttcaaacatatttccaagtaaaaggtattgcagttatcctataaactggcctcttccccagcactgcttttgctgtggtcaactttatttctttgggctcacaaaactgatagagcaaaataaggaaaacggaacattggattaaaataaattaattcccattctgtgactcactaaaaaaaaaatgataactatgcttctgtgagcattaataaggaaatgaataaggaaatgaccaaattgttcagtggacaacttgtatgggatttttaagtattgtgtcatcatcaatgttgtcaattagcatatactttgaaatcaactaaagcaaatcagttgactaatcattaagggtctttttaaatgacaacatctaaacagcaaatgttttattttggaaaatcatgacagcacaagaatgagccagatgttttacaacatgatatccataatttaaagtatgtagtagtcactcaaaggatttctatttcagtttccttatgatttggctaagctagaatttggaaaaacactttaaggtaatgtgagaaacagcaaaattcaacatgtggattttttcactaaagcttatttctgattattttttacaaactttactaggtatatgttaacttcatgacacttatagcagtggaccgtagttttaataaaatgtgaatgtatactcttttctcaataatattaaagaatgttgactttcgtgaggatatttttatttttctcaacattaagaactgtcaaagatttaattctacaacagaagacgtgaattttgttttctaaaggagaacagaatctatagaagaagtgttgctcatagtactcagattgttgaccaatcttaaaggagaaaccgtcaattaatttaccgagaagtaataacattatctttttcttcaattatgcacatccacaaagatttggggcaaaatccacttaaatgatattatacataatagatgagtattcatatgttgtaagagtcctggcttctttcctgcaaaatgattaaaacttggatcagaaaccaattaaaaatccattctaattcccaaatgtatgtaactgtactataagaaaaataaatatttcttcttgagggatatccattagttaaggatattcataacatggtgtcttgtaggaaatgttaatctttgggtgaatagggatgtttgggaataacaagactcaaagagatgttgcacttactcacttttctctgagttgttatttctgtcatttccccagtgcgcctgtcctcaactttgcctctctccttattcctttttttttttttttttttttgagacggagtctcgctctcttgcccaggctgtagtgcagtggtgcgatcttggctcactgcaacctctccctcctgggttcaagcaattctctgtctcagcctcccgagtggctgggattacaggcacccaccaccacgccctgctaattttttttgtatttttagtagagacagggtttcaccatcttggccaggctggtcttgaactcctgacctcgtgatccacccaccttggcctcccaaagtgctgggattacaggcgtgagccaccatggccgatccctccttatttctttttatctctacctctgcctcaatggtatttctctattactgttagcatttgctttctgtgagctcttgcacactgtcagcttatatacatgttcctgttcacatgttttcctgtccccagtggttacaacatgtcttctatctcagcccactctagaattgtcttacttttccaggtctcctgctcctcagtatttttcccacttttctagattcatgttttcccatctgcatatttctcttccatgtctgcactgtcatccgcttagaagacagcgcataaggacactgttatctgagcaaatcttcagcacagccaccatgaagcatggttaccttgtcactttccatttttcccatagtgtgtgcaaactgccctgatctgcatagaaaggtatcataattgaggaaacaaaatgcacaaaaatgtccttggttattccacccctcagaaatataggagagaagtaatttacagaattacacagaataacgctatgtcacatggacatggagttatcgggttagcatataattggaaaatatttcctaggaccttgacatttactcactttttgttttcaaattacatgtccctatctattagttgcaaattattttaatgcaccgtttaccaaagaaaggctgtttcttctgaaagctttcatttgacaagtaacttgtaaaaatattcacattgtgtatctgttttccccttctagtccaaactctagttatcttaaactttgcgcagttataaaaaatcataacaaaaaaagcttcctcgttgtcattcttgtcaaaacaggtttaccagacttaggtaaacttaaaatagttagtgtaaaagttaaaaagctgatttgctccttccagcgtgtttgttgcctttttgccacagcaaaattgtaaatgtaaacgtattccctaggagatgagctgggctgcaattttcagctaattgggagaagcagccctgagttgagcactgtcaggctgatttgagtcttaagatatgatgatgattattgtgtcaaatgtaatcaagaacgtgggctctgaactgactcaagggctggctgtttttaattcaggttcgtatatgaagtagacctccggttcaccgatagtcacagctggttgtagaagagagcaatttttaaaatgctatttcattctctatggagctctagggatcagagattggatgcacagggaggggacacatcctcattctctcctgaaaaattctattaattttcagtataataaactttctcttgagattccccagtggctctgtatcggtggttttcaaacttctcagacccaatgccacccctcttttcttttttaaataacaaatactttgtaataccttctttacgattataagccaaaatatgtagacaacataccctacttatacaggcaatagtttaaatgatgccgtaactctattttaaagagaaataagagtcatttataataaaataatatgtgttgtagtatgcagttattcaggcaggatcacactggaacacaagtgaagtttttagatcacgagactatcaatgcagtataaacaaatgcagaatgacaccattgtgttgtatggagactcaaataccatgaggggcattggtcatccatagcgtaattttccaaaatgctgaacaactcttggcaaaattcctaacaccatgaaataaattttttcttggatcgttatggcagttagttgcatggctgaaaaattcaatgtcttaaaatcatgaggaaaatatcttatgtttacgtgtaaaattgagttacgttccaggtttaggtgtttataaacagggtttccacatacatgcatgtccagtgggatattccaaagtgctgtcagacttgggagagttctttgttgtataagaagtctaccatcttcattccctctccacagaatgctattatagtaacactcttcaatcactgtgatagtcaaatgtcctccctcaatttctaggatgcctcttttttttgtggtctgtataatttggttaaatatctttccagacaaatactgatttgtgaattaatgaaatagcagtattttcggagcacctaacctatttctgagtgatacagttgccatttttacaagactaaatgaaattaccatttcagacctgccagattgtctagcccagtcttttacaattctgtgattatcactgcaattataatctattttcaccacttgaatggcatgatctctataaaagggtggtgataacactcatctattctccttcccctcacatagctatatcaatcgccccctaaccagttgttgataaatgcagttgaattttatgtaaaaattataagagatattattgtagctgtccaagacatttaaaatgctaaatgcaacttacgtggaggctataagagaaatatgaacccatttattgaagagattagctaatttagtaaaacaacacagatatacctgcatacagggataaatccctattgtctaaattattgagataaaataatgttttacaatgaaaaacttttagacaagtaggtaagtaaaatgcagcagtctatttgcatttcatctgggcatttgacaaagtctttcgttatactcttgtgaataagttggagaaatactggctagatgcaagataaattggatggcttagaagccacttcatgattttacgcaaaggatgtcgattaatagaccagtgtcaggtggtgatggaagatctctggtgctatgtcacaagcttctgttctcaaccctgacacactggatgtttttgacagaacatgagtagaactacagagaggaggcccatcaaacttatgggtgataaaaagcagggagggcaggagtattttgggtgacagaagccaaatgggtgtctggacaggatgcgttttaaggcacttttggtacttgatgtctgaagaccaggatcaaacttataggcaatctgaacatttgccaaaataacaggttaattttgacagaagttattatttgtatgctgtctatttctttaatacacctagaaagtattgaaataacattttttgcagacactcattttgaaaattcagaaaaaaaattgttaactttcgtggaagagtaacagaaactcagtcattgacagctaaatacaatgtgttgcccagtaaaatagtccaccccttcactttcatggctaatataaaatttgatgaaagatacaaattccaaagattgaatatctgtacatttgcaaagcaaaacacaattttgggcacagaattgctcattctcatttttaaacatcttggttataactgaacaatagttttttataacaaagataatattttcaaattattatgaggttcaactgaaataatttatgtgaaagcaatgtctaaactctaaaattctatataaatataaattattattcaataaattcacatcaagaaaattttaagttttttaagaacaagagcctatggccttgtttttagaagctgtataccttatcggtagtaggtttattgactttaattaaatttattgagtatctattaaattgccaggaactgtggtgtgaatctttgccctcaaataatttacagtaagttgtggttgatgaatggtgatgacgatgatgaatatccagactatagtaagtggtatattcataagtcagaggattcttaaaaccagatgcaccctcagattcattcctttcatgttgtacttctaattgaaaaaaataaatcctaaattatgactgttctttataaattttaattgatcttataaaaggccatcaatacatttcaaagtatctaggtcttttaaatgcaatttttcaccctggtaattaaaagtacgaaagcaagaaactttaaatctttattttgataagttttaattagctcaagctacttgtaatcccacatcttgtcttgtaaatcatatctgagccattaaaataggtttacaattagaagggcaattcttttagaatctacttaaactaagtcacttcgacaaattaattcatcgttcagttggttttattaaaatgtatttatttcactgtaaaatgtctagtaaagcaatgtatgaagtattttattttcatgttagaaattttatgtaaaagatatcccaaaatacatagacattcagatactctctgtatcattaaccaacatttactaacttatcatttagagaaggccaaaattgtatgtactataactttgtataatttcataagaattaaaatattcgattaatgcctgtaatgccttctttctaaatcaaatcctcaagcttacctcgagttcaaagttcagtatttattgtaacacatctcatagatgacggatgaagatggtaagcaaaggaataataatttcttttctcttttcacacatatatacacacataccccataatcctaattcatataataataacagaaaacaaagggcttttgagaatagtgacatattaatatccattatatttacttcacagggagactggcaagtctaccttgagaggtaatgtcttatagtacagtggactagattgtttcaagatttgtcatttattttggcaactcacccagcttccctgaaagttaagttcctcatctataaactgttcatgataattacaacctgcctcattagcctcatcaagctatttaaaatatgaaaggaggtgctatctgtggatcctgtcaaaggagcttgaaaactgcagaacattattttagtgtaaaatactataacaatacatgttgaatataaaatggctttttcttaacttttattttaagttcaggagcacgtgtgcaggtttgttatataggtaaactcatgtcatgggggtttgttgtaccgattattttgttacccaggtattaagcgtagtacacattagatatttttcttgatcctctccctcctcccaccctccccactccagtaggcttccacgtctgttgttcctctctgtgtccatgtgttctcatcatttagctcccactaataagtgagaacatgcagtatttggttttctgttcctgcattagtttgctaaggacaatggcctgcagctccatccatgatctctgaagaatctccacactggttttcacaatgactgaaataacatacactataaccaacagtttataagcaatgctttttctccagaacctgttatttttgactatttagtgatagccattctgactggtatgtgatggtatctccttgtggttttgatttgcatttctccaatgatcagtgatgttgagctttttttcatatgcttgttggtcgcatgtatgttttcttttaaaaagtgtctgttcatgtgctttgctaaaagggccctttcaaatgtgtattattaaccacaagagagtactgagtaagagactaggtaataaaagtcacaaatatttcgatatcataattcagaatttagatcagcggttatgaaattgttcgtatttccaaattccactgacaggactctactataagtttatttcatctgttgatatgtttttagccacttctttcttttaaagtgaatctgttgtgtgtttgccatttgatattagaaaactgaacctgcctgctttgctgtcttctgaatattatgtatcaacaactaacaagctacagttagttgttttgttctgtttttctctaagttattgtggatgaggatatatataactgcacagtcttatcaggtttgtaagagatgatcttaggctcatcttttaaattggtttttatactattttaaacaaatccttttaggagagaagaaaagctgcttagtctatcaacattaggaaatatatctttaaagagtttatcactgcaagtaaccaaagccaacttaaaaattcgcattatacaaatcattgagaatttatttagaacagaaatgtgtccaactataggtcaacaccaattttaagtgtgtaattatctgggaagtagtgttaactgcatttttttctaaagatcccttacagttgtataaatgcccaaaaggatattttgagtctctgtatattaaccaaaccaaatgtaattcattactcccaacattatatttcaacctctccaaatagtaccttttcgtattgtatcagcagaaaaatataaaatgcagatcttaaagagtatcaatctctttaaaaattcaagaaagaaaaaaatatgtgtgtatagagacgtgtatttcatctgctcataacactgtgtacatttctttatcaactaatttttttcagtgatttatgagttgaaatacaaatcaaatgaaacgggtaatgcaaagtaaagtagaaaacacattttctactgctgtctcctaatgcaggtcttttcaggaaagtactaatggttttagggaaagtgtataattatggttgtttccctaatgataaattcgcaaatctctattttaaaaacattcataaggttaaaaaaatgagagatgaaatgtgtctttcaaaattccttacgtgattgataatgcctatactctcttactatctaaagtctaggtgatatgtatattttttttaaaaaataaaatgtctgtatcagtgaaggaagtttacacagatagcttcaaagctgtggtttatctttggaggattaatctatttctcatgccagtgtgttgctactgcacatgttaaaaagtcatcctgtggtgtctggggtgacaaaagatgggaatgagttttctgagaactaatcagcaatactttgggaacatttaggtcatggtttccaattaactctggagagtttgagtaatttagtaccagacctcaagagagaggggatgaaaacctcgttaattcatatgttggtgaacggcaaaccagcaaatttgcattaaaaatggatttttattttaaagcaaagagcagccagatcttttctgcaatagtttgggtaggagaatatctttgtatgtatgtgttcccttatgtgtaggtatttgtatgtttcaacgaccctgcatatggcaataacagaaaattaaatttgtgctctaaaatgaagaccaggattcagtgacataatcttccttgtgcctttctttcttttagtacaatgaatatatcagagaggagtgtattccaatatctgtcttcagagttacaaaaacttcttttctagaatgcaagacttgggctatacccccagctctgccacttaacttgtatacaaccttgggaacatcattacaattctctcagaatcaatctctccagccctaaaatgaaaccagcaaaagcctgtactgtatatctaaaaggttttttatttttatgaaaattagttaggcaaacttttgttaagcatccatcactctattttgagataaagccttgctggatgatctccacctcttttgatggaaagagtaaaacatgtttaagatacatttatcacttgtttggcaaattgagatagaagtttatgaaagcagattgatatatgttacatttgagctactgggaaggactccagatggtttatagccttaattacattgtaactctagttaaatgtttacctatctgtaccctctgttaaacttgaatatgttaaataccaaagtccatgtattattggattttctgtcaccatcatcaggcacagatcctggtacacaataggtacggaatggatgcatggatgaattattgaattagatgttggtaggcatgtggaaataagaatgaggttcagaattaaagataatctgtatcgagtgtaaagccattggcagagaatgaaatatccagctgagtatacatagaaaaagaaggtaggtagaaaaatggaaaatatcttatgaagtgatgatagaataactctgaatatgtttgaaaacatataaagagttatgtggatgttagctttaaaaattatcttccatgctgtacattagatctgccattcttcatgctgtggatgaaaagcaagcatcagaagttaaattaaaatgatgtcatatattcctcgccttacagtttcataacagaggagaaaagagaaacattctctcattgccaccacccttctccagtcatatttctaggtagatgttgcccaaaaacagataaaaccacagagttggttttgctaggaatggactactaatccaggcaatgttgacagcttttgcttctcattagtgcacgttactaatagaattgctagagattaaaaggaatcctttctacaaagtgctgtatatccataggtgacaaaattctagcttcccctcacaagtacaatataaagttatgttttaaaatcaaaatgcaatttactagcaaactagtaggaactgttatggttacaggaaatttgaatttcagattaactctggttctatgagtagcggttgatatggcaagaatcattttgatcttacatccaggtgctactaaggtctctctgacctatatctcaccaaaaaaaggaacaaaataatgatcctttaatctttctcctaaaatatcataggaaatgatagtggctaaattgcaaataaactaggaaggaaagattcagagtattttatgtgattactctataacaatgccaggccatagtgaaagtgttatttagcagaagactgagttctttgaatgttcctaatttatcacattttaaaaataacctgggcaaaataacctttcatatcagattgagcctttttctaaaaatactcaatatgtttctgtaattatacctacacacttacaattccacagtataatgcaccgataaagtatttttcatccatatatctaatagtagaatggtgtgtatacaataattaagctctttaggcttaccccggaaagcaacaagtttcccttcctttttcctttttatgtattatgttggccataagaaattgatgatattcaactcaatgcagtcttagagatttattcagaaataccatggtgtgtgtgtgtggcgggagtagggttctaatgacaggtcagaacttacttatttgatttcttcattgataatcaggtcttaaaaagaaaatgggtatgctgaaaacatgccttctgtgattctttaccttcatgtgcagttgtctctggataaacactttctttggcacgtatagggttgcactaagctttatagctccaacactccgccccttcagtagattcttgcttgtaactgatgataatgcaaacctgtattatctataggtctccttaaagggcaaccaaaagttcagtagcaattcaggcacaattactgcatgtgagaatcctccatcttgttccctttggagaccacatatatttcttaggcaagtatatttttaaaatccttgttcagcatgacaattcaggaggtcaagttctcccagaaagcagattctgagaaagtgattagcatgaaggaattttattggagagtgctctcaggattaacacctgtgagcggaggaaaggaaagggagcaggattgggcagaaggagaagctgggctaccatacagtcacaactacaacacaatcaaccctccgcctctccttcctagccttccccaggaggatctctgaagtctgaaggtagaatagcccttcagaattgtcctgagttgcagcaagggacccaggattttataccccacaactctcccatcaaccaatacgtgcagcccgtctcggggacatagtgggtaactttgggctaggcacctctctttagctgagtccagctctcagacaggaataacagctgaggactgtcagccagtagcactaccagcagctggggtcagaagtatttcagtcctgaaaaggggtccgggcagcccagcttagcatctactatgccagtcgttctcaaatctggttcctggcaactgtgattctcaagctttagcatatattggaaggcttgttaaaacacagcttgccggattttacccacagagtctctgattcagtagagctaggctgaggcctgggaatttgcatttctaataacttctcagacgttgctggtgctgctggtccatggactatgagaacactgtttcatgctgcccttatttacatactgagaatggtacacagtgctcttatgaatagaatgaaaaccttttgaaatcacattattccttactccatcaaattctcagctatttttgtgcaccataaagctggaatagctgattataaaactttgttatgtaaaaaagtacttaaccaatacagtagattctgtttgcaaagcattattacagtttctaatatctggtcattgttacttgtaaaattcagccaaattttctccagggcctgtagtttgataacttggacaaaggaatttaaaaaaaaatctaattcaagacctttggttttttttctgaacatatcttttttttctttatgattcttatttttacattttacttatcatataagccacttaaacccatatggttccggaaaatttaaaactatatgatacatttagagcatgttgaatgcacagatatggaaattaagtattcttgactcattctagactagacctggcacaattaaaatttagggattcaacgtacacacacatagattccgagagaaatgttgaagccgtaaaacccccacacaagcaggaaacaacagtcttacctattattcaagaggcacgtaaaggagctcatttgaggagattttctgctgttattgccatcgaatttttaacgtattttccaaattagaaaatattcagcctgatgttgtcaatatttcagaccacaagggtatcatttaggaaaatggtttcttactgtcctgaaagagttactgttcttccctaagggcctaatttacaaagcagcaaacttgctggtaggatttggctgaaaatcacattgtctcggtagaactctttcatctgatttatgtgcattgcattttgcaaataactcttggaaagttatttactagttactttctctggaagcagagggtaagcggcatttctagtttaaggatagaggagctaagatgcatcaagcgcagctcatcatgaagctgatgctgataaaatgcacaatattacattctctaagtttcactctgccatgggagaatttcatatttttaaattttgtttgaaattggactacattagaaaatatgtcaaatgtctaaccctgcatttatattctggaatgtgacagcttatttctgttccaaattttgcactggagatggagtaagtcttaatgcaaactgcatgaaactgccacttttataggtcacacccagtcaattgtcagcagttacacatggttcaaactgtaaggtgtatgcccaattgtagcattgagattcgtggagttgttgcagtggttctgaatttttcaagcatgatacataaaaagataaatgactcttttgatatttctccttgcattgatagtttgcctgaaaactagataagcagggagccggcagtccacgttagcccttgaactacatgaggtttaatttatttgcccaaccagaaccctacactacctttcagctgtgcagtattaaagtttatttaggagttgataaatagcttagtgcaatgcttccttttttccagtagctacatcctcataaacctattctaccctccaccagttaatgcagacagaagatttttatccagtatgagcactgaaactccactgtggaagactgtgtgctcagcaaaaacctcacccatgatgaataaacagctcttccgggggctttgctgccgctggctcggcaggagttgtttattgcctggtttgcacatcccatgataaagttgctgctgaaataaattgcagttttgcataattattgacaatcacatcttaacaagcaatgtgtatcatattcaagtgttcaattttttaaaatccatttttagcttatgtttaatcccagaaagtgtttgtgtagtaatagaaggcaaataagacatttaaatagagtactaatttcctcattgcagacaaagtttacctgaatctttttccataggactgttactgcctaaggcaattttcctttctaagctattattatatagatatttgctgagggcatatgtgtgtgtatccacaatacatgcattttatatatatatatatatatatatatatgatcaaaaatatgaatacatttttagagtttttgtcatgaaagagtttgtttcatctttttaaaatattacaggaatggggaaatgggatatgggtagaaggaactaatgtttttgagtaactgtaatgtataactgtataacgtggggcactcaacttcacaggaattttttattttaattctcatcacagcaatagatattgcagatgagaaactgagaatcagagagggaacttgccatatcacgtaagtggtaaagaacactgggaattgaactcagatctgcctagtttttaaaactctactctttttcattacacataacatttttattttggaaaatgttctcagttgtatgatcaagtagttaaatatgaaactaacacaataattataactgatgtcatgcaaaatgatagtttgcacaaaatgatagtttctatgaaatgttatttctttacttgttaagtctttcttcctttgccctccaatccccttctttttgtcttttcctctagtcttttccttttgattctaggtttgtattttcttgacttttctccttgcatatcaaatccttgttttctgcctcagagcagcatcaaagacaagcatggtacagggattttagggttttaactataaaggtttgtctcaaatttggcagtatattaaaaataagctttcaaaattgaccaacaaaaactacaaaattgaaaaaaaggtactttgaactttcacatgttcaaatatatgtatatatatttcacatatatatatgaaacctcctctgtggagaggggtttatagaaatctgtaattgtcattcttgcatgccttcccccatacaaacgcctttaagttaaataaaaatgaaagtaaatagactgcacaatattatagttgttgcttaaaggaagagctgtagcaacaactcaccccattgttggtatattacaatttagttcctccatctttctctttttatggagttcactaggtgcaccattctgatatttaataattgcatctgaacatttggtcctttgcagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagtaagtcaggcatttccgctttagcactcttgtggatccaattgaacaattctcagcatttgtacttgtaactgacaagccagggacaaaacaaaatagttgcttttatacagcctgatgtatttcggtatttggacaaggaggagagaggcagagggagaaggaaacatcatttataattccacttaacaccctcgtcttagaaaaagtacatgctctgaccaggaaaacatttgcatataaaaccagagcttcggtcaaggagaaactttgctcagagaaataacttagggattggtttattaaattttaaaagttgacatttttgagtgtttatttaatattttacagggaaagcatctgtatgaattgtctgttttatttagcgttgctaactgaatcagtttcccttcattactttcaaatatgttttgaaatgttaatctggcattttgtagctttcttcctaacatgatctgtgaaaataagaatgagatggctgaatttgtcgtagttaatgatcaaacaattttcagacaattgtttttcctagaaacaaaaattatttccataaagttccatatgcataaacagtgaaaacagaacgtggggtagttttgtttaaatgaagtcttggtgagaatcatattctgtagtacaaggaggctcttaaagtttattctcaatacctgatataattttcctgaactattatggagttttgttatgtatagttggtttttctgacttgatataataactttactagtctctcaaatacaatttggatataaatcattataataagatgattgattttttagactaactttattttttgatatttttaaactattatgaaaaactattatgaaactattatgatatttttaaactattatgaaaagtatattctagtttgaataattccagaatcaaatcataataagcagaagttcttctcctctccctcctatcgttctccttctcctgtttttcttttttgatatgatagttgatctactttgctgctctgttgcatagagtacgtaacagtggcaatgtatggctcctgaatttatcgttcttgcttcatcatcctgctttgaccccactttctcctccaaaatgcgtgttgagttagtttgatcatttggaggtaatttgtttggaacagtatcagactttatagatatctcccatggcttgtgatagaatataagggcaatgcaaatgtagagttttttgctcactcttcgatgtatggttagacaatgtaccactgtaatatatttggcttaggctatttcataaataaaattttattataaaatattataaatgctgataaagctactccagaattttaatagatatgtgggtttcccggccagatgcggtggctcatgcctgtaaccccagcactttgggaggccgaggtgggtggatcacctgaagtcaggagttcgagaccagcctggccaacatggcgaaaccccatctctactaaaaatacaaaaattagctgggtatggtgacctgcgcctgtaatcctagctacttgggaggctgaggtgggagaatcgcttgaacccaggaggcagaggttgcagtgagccgaggtggcgccactgcactccagcctgggtgacaaagtgagacttcatctcaaaacaaataaataaataaataaaaatacatgggtttacattttacccatcagctatggtaggtaaataataagctttgattaagtctattttagtctatttttagcagattactttgaaaaataaagaataacccaatgactaaaaaattattttatgtcagggatttaataaaacatatctttaaatctagttgagggcaaaaatacgtctattttctactatacaatttgtatttatatctgctgtattatataatgaaaatttatctctatttctaatctcaagaaactgcaagcttctgaatcattaaagggaagattcaccatgtgtcctaactatatttactatggaagcatggaaaataaatattttatgtttagatttctgatctctctttcaaaagcagttggaaattatgctgagaaaatgtcttagcttatcccatgttactcaagaaaatgtatttattcgtttttgtccagtggcttaaccaaaccacagtttatttgttgctcacataaagtccagtgtcgatcaggctactcttttccatctttgagctaaggcacatattacacataactttcagtgtacccgaggtagaaaaagagagagcttgggaataaggcaggggctttttactgtctcaaccccaaagtgataaactacatttattctcaaaatccagataaaactcccatagagcctctgaaaacctcaacatttgcgtcttaactataataaggttaactaagattccaaaattattttaaaacagagacagtttccctcttccctggcagctaatattgtattttctataaatccacttgcccaaggtttaaactacattttatggattgaaatgacatttatagccaactcctgatttttagttagatggttggataatgatcttttgatgaaagactcggagatgtcatggtaaaacggtgaactactgaaactattgattattgttaatggcacatttcagctgattgaattgagtcaagaaactggtgttgaagagcaacaaatggaaatgccgagcttgaaaataaataaagcagcataccttaagagattacatgcaatttcagtatttcagctaaatggaagtgtttgctttttttcctctatgaatttttattttgaacaaaaggaattttctataatatgtaggtaggagaaaagtgaaatggcatgctttttcacttcatttgaagaagctggtagcattgtattcatagattcatgctgtatagcaatcatagttctcatatattaaaaaaaaaggaaatttgaaatgcctagccaaagcaacagctctgccaacagattttgatatatctgtctaccccaaaagtagtgatgatttacttcatacaaatgctagtgaatgaagagagagggtgaaaaccttcacaaaatgtgtttttctctaagactgtcaatccgtttttctatatatggagactccagctcttgctagactacctatcactttcgtctatcagccacttcgtaagatatttattctctcagcaataatcataattcatagattctttaaacatacatgtaatataaagcatatacattctgaatggaattaacatgattaattcttctctgaaagacattagaatttcctcccgtattataaaaaggtgtaactcactttccttactaaaatcaagaactttaccgtcgtccttgtacttcaggataagggggtgtttcttataaatattgttatttctgatatgctaactggaatttttaagcaaatgtatttttatagaacgccatacaaagcctttaggggtgaaagtttcaggatttttaaattgcagatttatcctttaaataaaaaaactatattcgtaattgaatcggattatttctctatccaaaacattttctgctttgggcctaagaagagttgacaaagctgttcatggttcaaagtactaccataaaaccctgggtaactaactgaaaatggaaagactctgtctttctgaatatttcacaagagtttcacaaatattaagtggttctctaagtacccctgagagatcattgtaatattagcttgtaaagacaatgtgggggtgtgggtatgtggtgacctttatgatgttcataaaggtggtgtaattaacatatttttctcagcaagacaaactaaggagcaataaatatatgagataccttcatctgtgatctgggtcatgtctcaggccatatctttcaaatcactcccttccctaatctcgtgttttacctacgtctcctctcaatccccccattataaaaattgtcttctgatgaataaaacatttccagagagacaagtttcataaagtttgaattgtacatctgagtacacctatgaattaagatatctttgatttctaatatgttattaaaattgggtgtggtggctcacgcctgtaatcccagcactttgggaggcagaggcgggcggatcacgaggtcaagagatcgagaccatcctggccacaaggtgaaacccccgtctctactaaaaatacaaaaattagccgggtgtggtggagtacgcctgtagtcccagctactcaggaggctgaggcaggagaattgcttgaacccaggaggtggaggttgcagtgagccgagatggcgccactgcactccagcctggtgaaagagcagactctgtctcaaaaaaataaattaaaataaaataaaataaaattggagaagtttctcaccaaaattttggcgcacggattaattctgaagaaagaagaaagaatgcaatcttagtagcacaattagtaccttgaataaattggagtatcgtatttcttggactatctgagaatgcagaggcaatttaaggatccctaattctaaggagaagaaacctttagtgtattccttcctgttgctttagtttgaattgagttttatatgtattttttaatctttctattttgattgttgtctaaagagtgtgaaagtgaattttgatatttttattttgcctggcgatgaatgccttctgctctggatatttaaaaattatatacacatatatgtgtgtgtgtgtgtgtgtgtgtgtgtgtatatatatatatatatatatatatatatataaaatttttctgagaacttttattaattcagcgtatctttgctaaacacctgccatgtgtcgtggtgttaggtctggtgatacaaacatgttcagagagatgattttctttcttttttggggggtgggtaagggaaagaaggcttatacaacagaatcttatttctcacagttctggaggctgggattccaagatcagggcctggtgagggcccctcttcctggtttgcagatggcttccttctctctgtgtcctaacatagcaaagagagacagagctctgatgacacttcctcttgttataagggaactaattccatcataagggccccaagaaaggtgcttttcaaaaacagttcagtaaaagtactgggttgtataatcactttaatgagtatcaatccatatttttaagatagaaatgaatgaaattagtaaaatagaatagaaataaggagtccatcacttttaagtaagtttcaatattgttcgtaaaactttggttcggtggtttgtgtgtgtgtgtatttgtgtgtgtgtgtgtgtgtgtctgtcggtgtggaaatactggatcactttgtaacatatattcaaaagcctctgtattttaacattatttctgcctttgagaggttcacattccagaggtgaagacatacatcctaagacaaaattataatagcattatgagaattacagtagagagctggacagggtctagcaaaaacagaagactaggctaaaccttccaaagaggccaggaaactcacctagaacggtggattttaaccttgcttatgcactgggggagattttaaaaatatctctgcccacaatagataccaactgaattgagcatagcatgtcctacccatgaatctattgtccagtgagaacctctgtttagagaaagtcaccttagaagaattgttaggagttatttaggttcatggggttgaaaagagcattcgtgatagaggaaacaccatatccaaaggcttagtcagtgtggtagtgtgagaatctgaaggaacttggctggggtatggttgctacaagaaatgaaattagatcaactggggctaaattatgtggaaagacagcatgatgtagcagctagagtatggaccttgtaagcaggaagaccccttatttagcacttactagcttattgtctgacctctgagtcccaattttactcttctatacaatgagtacatcacaggattttatcaggtttaaatgataagatatatgtaaaatgcataccagagaggcagactattggactcgaagggctcagtaagtgtaagctggctctctctgccccttgccacctatttttcagactctggacttttatcactttaagtcatagcctagttctaagcaaggaaatggactaatcagacatgtttttaaaagatcattctggtagtggttaggagaatgaattggaaagatatgagacccatgcagggacaacagttaggacattatttctgtaataagccaagcaagaattgatgatcaaagtggtgaggttgaacaaacaaaacagatacgtgagctatttggagataaaatcaacactgtcatatgttttgtgggaggtggaggtgagcagaaaatgtgaggtaaaatgagaaatcagtgcctgcttaccacttggcatgattgactgaaggtagtgtcttcactcaatcatgagttgcagaattcaagatggcaaacagttgtgaggagcaaagtcaagaacgtgtttgattttgaggtatctgtaagtgaaaaatcagaggtgaaaaccttacctctcttgaagcagttgtgaatgtaaatctaaggtttggaaaaagatctgggttaaagatttaaaattgaaggacatcaacatggaagccatagaaataaattatattacacacaaatttatgtcgttatttgaatttctccatggtccactcagaaatatatctaaatgtcaccaaaatgttacttactgtagtacagaattggtattaagtgatactattgtccatgttattcaaaaagacagttatagggaccctcttaataaactaattgtgaaaaaggcaaagaattagcaaagctttggcataaaattcatatcatgggccaggcgtggtggctcatgcatataatcccagcactttgggaggctgaggtgggcagatcacctgaggtcgggagttcgagaccagcctgaccaacatggcgaaaccccgtctctactaaaaatacaaaaattagccaggtgtggtggcacacgcctgtaatcccaactactcgggaggcagaggcaggagaatcgcttgaacgtaggaggcagaggatgcagtgagctgagatcgtgccattgcactccagcctgggtgacacagtgagactccatctcaaaaaaaaaaaaaaaaaattatgtcatggaaaaagtaaaagtctttgcataatgtatccaagatcatgaaaaactcttttcaataagataattagttccttttcttatataaacatggaaattttcatttttccttttattctcatattgatactataaaaaccccatcctcattcacaatactactgtctctaccctcgatagataccagttcaattgaacgtagcatgttctacccatgaatctattgttcagtgagaacctctgactataatgctcaggaatactcaagactcacatgattgtcttcttgctatatttagttactttattattttccattttgggaccctgaattcctgtagatctcagagaaaatccgaaatgaaataatgaaaataattaaaagtttagaaaagggagtcaatggggacaaatgttcaggactggtcttttatctcctgcaggaagaaagactgaatgcagaaaattagaatccatttttcatccagtcaccccaatttaatgcaatatgagtttagctatttgattttaagtgttgtaccgttttggaccatgttaccatggtaacatgaaccatgtctcattcatacgtaaacatgttaattgtattaaaacctttaaaacctacttctggatgttgccattacattaaacaattatctagaatgatacaaagtaatgactaaattgaataactttgtaaattaactattggattttgtaattttatatctataaaccaaaagaaaagcccacattggtaagaagacactgtgcatactgaaaagtcaattttgttagcctccaataaccattgtgttttattcctcgcagagcttttgtgaggatcttataagggaataaatatgaaagcactttgaaaaagctttcaagtgaaaggtccttattaattttatgaattaccattaaacaaaagtcaaactgaagatgtaaatctaataggatgctcttaaaagtcaatggatcaaagttatattaattaataaagaataataactaaatattttatgtttcataattggcaaagtatctttactgtcattttctaatttgatccttagtgaaaacctgtgatgttggtactcctattatttccattttcatttgagaagaataaaattggagaggttaagtaatttatctattgctacttgttaaaataactactaaattttattactcccagttaggagggcaattatataaactaaaagcttgtcacaataaatgtttacttttctgggattaaagtcatcatgtatttttcaattattaaggggggtaataataataatagctacctttttaaaatagttactatgtgccaaggtgtgtactaagtgctttgcttgcatgatgtaataccatcgtatatttagtacagaggaaaaactgagaggctgggtaacttctactaaggtaacacacaagtactggttgagtatcccttatccaaaacacttgggaccacaagtgttatggatatcaatttttttctgattctttttttggatttcagattttttcagattttggattacttgctttataattatgggttaagcatcccaaaccccaaaattcaaaattggaaatactccaatgagcatttactttgagaatcatgtcggcgctcaaaaattttcagcttttagagttttttggattttggattttcagatttgggatgctcaacccgaatatatagaaaagtcagcatttgaacctaagtttgactttctgatcttctaccaactctactgtcctacccattactctacattgactcagcattacagggaaagacccaagatcaccaaaagcaagcttcaaatcactcatctaatagaaattagtggaaatatttctacttcctaaacatccatctttcctttacattttaaagtcaagtttctacatctgcctcccaactgaaacacttctctatgaaatcaccataactaccaaatgcaaatatttttatcaagtcctcattgccctagaaatctactcatattttgttattactgctcactacagcctactgaaaaatgtctcaccttttgacttgccagggtgatatattatactaattgtctccttgtctctctaagcactcattccttcctctttctttcttctttttttttttttcacttttattttaagctctaggggcacatgtgcaggtttgttacatgggtaaattgcatgtcatgggagtttggtgaacagattattttgtcacccagataataagcatggtacctgataggtagtttctcagtcttcaccatcctcccaccctccaccctagagtagatcctggtttctgttgttcccttctttgtgttcatatgtactcagtgtttagctccacttataagtgagaatatatggtatttggttttctgttcctatgttatttcacctaggataatggcctccagctccatccatgttgctgcaaagaacataatctcattcttttttctggctgcacagtattccctggtgtatatgtaccacattttctatatctgatctaccattgatgggcatttaggttgattccatgtctttggtattgggaatagtgcagcaatgaacatacagctgcatgtgtctttatggtagaatgatttatattcctttgggtatatacccagtaatggcattgctgggttgaacggtagttcagttttgagttcttagaggtatttccaaactgctttccacagtggctgaactaatttacattcccaccaacagggtataagcattcccctttcttcacaacctcaccagcatctggtattttttgactttttttttttttttttttttttttttgagacgaagtctcgctcttgtcccccaggctggagtgcaatggcgcaatcttggctcactgcaacctccacctcccgggttcaagtgattctcctgcctcagcctcccaagtagctgggattagaggcgccttccaccatgcctggctaattttttatttttagtacagacagggtttcaccaggttggccaggctggtcgcaaactcctgacctcaggtgatgcgcccgccccggcctcccaaaacgctgagattacaggtgtgagccaccacaccaagcccacagtatcaattctatgcattcttttctgatttcattaatctcattatcttcatttgatatttagtcaatagttactgtcagttatgtgttagttattatactagaaacagtcttttctccatctcctttaatccaatgatttgaacatttttattcctttccaatgtctgtcccacatttcttactgtatgtaggacatttcttactcaaatgtctcacaaatgacataaattcagtatgacccaaataggccattttttataccaagtcttatttcctatcctgctgttcatcccggtaccatcttttcagtcagagagttcagatcatatagtcatttctaaatctcccacttacttgcctcactttcaagttcatttttaaggtctgtagattctgcctccctaattctttatgaccattcctttctcactagccccttacctccactctcattcacactcttactattttttaccctcctccactcattcctgcccaccagtggctccaatccaacttgcagatttccatttaaattaagcttcctaaaacatagcttaggttgtaactacaatgcaaattccatgagagcaaagatttcatctgctttattcacttgtatatatccattgtccaagactgtgtgtgtcacatgaaaagtgttcaataagtatttgtcagtgaacgaaaataatatatgactcccctcttcaaacaccttttttgacttcaaagcccttcagaatattctacagactccttcacctggctctccacaattgcccctgagtctcgtttccaatcttatttcttattttacctctcaatgcaccttcaactcctactaaaatgaacagctagccagcttacttctgtgtctttcgatgatcttgttttttgtcttgagattcctttttttcatctaagcttacccaaacattacctacttttcaaggaaagccattttcgaatcttccctttttccctgagcccccaagctggaagacatcttgtctccatctcaattcctataggcatttctctgcactttaaatgacgtttagtacttctgacattgcattagagagaggctggggtggatagtgtttcatagtgtgaactttgaagcccgactgcctgagtttaaatcgtgattctggggcttactgaccatagacgcatttctgaattgctctcagattatggagcataaatcaaaagtaatgacagctacctcttcaggttgttgtgagggtgatgcgaattaatgtactgaagtgcatggaacagtttctggcacacggtaagcacccaataaacatagctaatattatgttattactattttcaggcttatttttatgtatacatatagtatgtaattttatgtcaatatgtataaatagactttggtattgtttatttcactatcaccttgagagcacaattctcatttgatttgtgtgagaaactacttagaaagaaatagacgtgtgaatgaaactatgcttgaaatattggttactgtgagtgttgaaaatccattttgtttaaagaaagcttcaattgttaatcttccataaattttagttcttaagcgttcatattgactcgttttggaaaagctctttaaagtcttgggatataaacaaggctgaataccctcattcatgataacaaacatattatactgaaaattgtaagagagatattttatctttcataatgccctccttgggaaaatacattgacttggcccttctctttcaatcagacaccaaagttgagattgcctgaaacacagtttggtaaaaggagtttctttttcccaaacatcctgagtaacacaggaaatcacaccaatgactgatagataacgttaataaaattaataaagttgttttaaatgcataccatggggcagtggcaatgaaaacattgagaaggctgggactatttgccaactttctttgatctccattagaacctggacaagatccacataatttcagaacttcttctccaaacaagaattgaaaaggtcaggaaaagtttgaccacagaaaaatgtcaaagaattttgtgtcactttctcctcctcccttcctctaaccttgaataattttttagggttattggtctttgggagcagactttctagaccaaaacaaaaaaaatgatattcctctatgtgataggtaacaatcactacccatcctactggaaaattctcaaagtgtaaattgaggggataaaaaaagaatcttaagtcctttaaattatttttaagatgaactacattagtgcctctcttgtgcctttcataattctgataataaaacattccaggtattagtcaaagattaatggtattgaaaataatttaggttatcagcatgtgattttcattccacatgaggtccttttgcagtttacatggttttctaaattatattaaaataaaatgtcagaaagttcacatttttttcatgtttaacagcatcaatctttaaagaaaagttattgcacaaaggtctgtgcataaatcagccattctccgaagaggtaaaagaagtcattacgcctggttatgagagagagtttcatgaatgtaagagacataaatcatttcccactggagatcatattagtctagatggaagaatgtctgtttcttgatagtgagaaagcaacaaattacttttgtttgctcctgagtctgtggttgtccttgagaggtctgttagcatgttgactattgactattcaatattagcattataataacttacaatgatctgagtcacataaatataatctttcagttctctaaagattttactttttcctctctaatatctattcacctccaacacctttgcaaatatattattctctgggagttacaaagaaagttattctctgcaggaagcagcatttcagttgctctcaggagccaaccacatttcacctcaattctttgctcccaattcaacaattcaatattggattaaattcaaggctgtgaccccaaatagaatgagacctggatatttatgaaccacttgaccaggcattcttcccatgatttactccataaatcctttttagtttttgcagtagctttacaaatatttggaaaatggctgtgcaatgcagttttaaaaagtgcaatgagtagaggtagcttcttcacctggtatggtaaattgttgattctcttttggagtggaaaacaagtgttcttatttggatgcaaccattgcattgattagacaaccctaaattcatctttcatccatgacctgaaagaaattttgaaattcatgcaatatatacccgtagtggaaaatgtactttttgaatggattcctgaatgtgacttttaagaagagctattaagaagtgggatcttctacagaacagtaaacaggcatgaaaatatacaagttgataagatatggaactaccccaaaagaggaattaatagtggtggggcttggggcaggaggacagagagacctagccaaggaaggaagggctatattataatagagtacaaagtcctttagtcatccaagagaaggggcaccttctgcatcccttatgagtaagatcagagaaggtattctagttaacttttgctacataacaagccagcccaaaacttcatggcttcagtaaaaattacttgttttgttcatgaatctacagtttgctcaaggttcaatggggcttgcttatccctgtttcagttgatatcagttggggtagattgcctgatgctggaggattcacttccaagagggctcactcacatgcctggaaaataggtgctgactgtcagtttttcttcatgtggacctctccatggagcagtttgggctttttcacagtgtaagagttgggtcccaagagcaattatcctaagggacaagaaattaaagctgcaagcttctcaaggcctgccctaaaagcaagaatggttttgcttctcccatattctatttgtcaatcagtgacagagctctgattcaaggggatgagaacataaactccacctttccatggagaagtatcaaaaagttttgatgccatttaattaaagctgccatacaaagtttcttataaatgacactgagctgaatgaatactaaacagcaagtagtcattatcccagtcaagagaagttatctttgctcagaataccctttctctccttgtctacctggaaaattcaactcttggccaaagccctacctcttctcgaaagcattaccaggccttgcctctaagtgtacaattggagatacaccagtatactgatgtttttaaaactttaaacttttttctacaataaaacataaattaaataacttcccttctgacttaaaagctgcaaaatgctcatgacagtaactatataaattaaaattaaatcttaagcacgataaatacctctcgaatagcaacatagatgcttacttctttatttcacttctttatttgcttttctttgtctatagtttgccccaaaggtattttaataatatcgggttccatgtataccagtgtgtaccaattaatatttagaatatacctgttaataacctcatttgcatagccctactaatctgagcacagcgcagccttaagaaagtcttagtttttctcagtttagttcatctctcttctcttctcctcctgtctctcttatttcctatttctttttcttttcaagtgactttcaactaagtagaaaatgcatttcacatcactatgccggcctccaggctctgtctatttcattcacccaggaatgccctttctgaatgctttctctcatttagcagctatctattgaagttggacaaatgatagaaattcatttcttaaagagccagaacatcatcttgaacaagaagttaaaagaattcagcaaatcaaaagatgagctaatatgggtgaatcttagaggcattatgctaagtgaaataaaccagacacaaaatgaaaaatattgtatgattccactggtatgagctacctacaacagtcaaatttatacagacgtaaagttgaaggatgttaccaggagctggaggaagaagagaatgagggcttattgtttaatgagtacctgagtttcagtttgggatgatgaaaacattctagagatggatagtggtgatggttcaacgataataataatataatattaatgtacttaatagtactcaactgtatacttaaaaatggtcaagaaaatggtaccccgttatcctgatgtgattattacacattgtaggcctatatcaaaatatctcatgtaccccgtaaatatatgcacctactatgtacccataaaaaaaatttaaaggctaaatggccaggcattgtgggtcacttctgtaatcccagaactgtgggaggctaaagcaggaggatcacttgagctcaggagttcaagaccagcctgggcaacatggcaaggccccatctctacaaagaattcaaaaattaactgggtgtgggagctcatgcttgtagtcccagacacactggaggctgaggcaggaggattccttgaacccaggaactggaggaagcagtgaatgacactgtaccccagcatggtcaagatcccaaatcaaaaagaaatgattaaaatgatcaattttatgttgtgtatattttgccacaatacaaaaatggggaaaagcctattcgcttttaagtatccttaaaaaggcacagcttcttcagctaacagactctaaaactttttttaatagaagtattaaggtatttagagagtgcaaaatatcttattttaagtcaagaagttagggtcctgttcctaaacactagcctctgtaatcctggggaagtcagtgctgttggagatctcaggttgatcttctgaaaaatgatggatctaggtaaaagatatgtttctccaggtttacataccacggacaccatctttacttggaaactttattaaaaatgcattgtgtcagaagctctctggggatgggtcgtggaatctgcatatgtaaagagcccctaggtagttcttgtgcccacttaaatttgagaaccactagaccagatgttttgcttatggccctttcagctctgaaatttgaaaaaaaaaaaaatgattctgcaagacagagtctctgtgcttttgcaggataaagaaatgaagaaaataatacttcctgcttgtgttggagcatttttttcatttggtatccccatctccagtggctagccaatcaagaatagtattgtttattcttcccactgttttgaagatacaaaaggaaaagctaagccagatgacacctaaaggcttccattaccattttcatgtttttccctttgcataaaaactgtccatgcctccatcagagccatgatcactagtacaatgttacactctaatgactcatgacattaaattatatcttagcctaatatgaccaaattacaatatcagaataaaaatttcttttttcaggttgaatcccataacttaatccaattataatactggctgaatttttcacaattatgtctcagtcttgatttagggaatcttctctttatcataaaaatgcattttgttaaacatgtttcattataatcaatttctcaaaagtaaagttaatcaagagaaggaaaaaaggttttgttttgatttgatttggaatgtgtatgtgtgtttactgtattgaaatagattctgtctgaaagactgtatataagataaaaagtacagaagagtagtcagagagttattacccacccctgactgatggtgaatagattatctaagtatcccgtaaaaggcacaactccttcaggtatattttacaaattaattagtaactttctagccaaatttgtgtcttaaagacaccagctagaacttggttagttctagcaaagaagattattttattctgaaacaggtttttgttgtcgttttacttatttgaacttttttcttgaatatgtatttctttgcacataaaatatattgacttatgaatgtgattaaaatggaaaataattagttgattttagagagacagagagaggagaagagaagtgtgaaggagagagggaggatagaaaggagagagggagaacaggaaggacagagggagaatgggaaggagagggagagagagagacagagagagaggaatggagtgggtaataagcaagagaaaaatgccaatcatatgctttgctagtgtgtaaagtctgataacccaagggagagaggactactctggcctagtgaaacaaaggaaagagaaatatggtagaatattctcctggtgcttcaccaaatgtgacaccagaagtctgacagaagtcatgtcagcatttgagctccataaaactcaggctatcgacctaccatgtgagagtctcaaaatgagtttaggtaggggcagaggagttgaaatccagtaacatatgcaacagtgatcacaccaggattgcacatagaaagcaaattagtcctctaatagagacgccaatttgaaattcaccctctgagcaggtttttaagcacactcttcttttacttttctatttacaaaaatggaacaccaccagaaaaacaagaatttgaaagacgagatgagaaaagtaagttgtaattggaaacagacagaatgtgtacacaaacacacacacacacgcacacacacgtgcatgcacaggtgatgagagagtagtttgcctacatggtgtatctgactaagaagactttttgctctggttgtcttacaggaagtgactaaatctcatgatgtgaaatattttcttgcatattgtattggaaaagaaaataattttcccaaactccttaggggcagtgttgtcttataattcccatatagtatatgctcttcaagtaagtaactccagagttgagtaagacaagactcgtgactcagatggcatgctctgctccctagactagacattgcatcagtctgcctatactcacatccgctgttaaaggattgcctccagtaaaatatgtcttttaattccttatacaagaatctggaaaaaaaaagtaagattctctatttcttaaatttagcagcaggttaatcactgataacaataaaaatacataacaatcatctagcacgggtaaatattgtggcaaaaattacaccctgaagaattcagtcaaagatataagtaagtacacatcattgtcatgttccacaatatatcatctgctttaaagaaactgttatgtagctgtagtagatttaatcattaatcccatttcttctccaccttctgcaatcacaaccttaacaatgcctccttatgagtggaatgtacttcccaacccctagtcttaggggttggccatgtgatttgctttagcaaatggtaaatgagcaggagtgagaggtgacagttttcagcctaggccttaagagatctatacattcctgtttgtgcttctgctatcattctgagaacacgtccatctaggctgctggtctcaggaaaacgataaaagacatgaacagcagggctgcactagccattcacatccaggaaaagaaatgattgttgcataaagccattgagctttattctacattactgtgacaatagctaattgaaatagtaaatatactttggtttttcctaaatgcatattgaaaattaataatattagccatctgtatgataaaaatataaagcctatgttttattttttaatggttcactgccctaaataaatttccaaaaagtagatgttcccttgtctagtgatgtcattatattttatttatacatcataaacacactgtttatttctgctcatttttttgtaagtaacatgtgttaccgccaatcttgagatgatacacacacttctgtactaaattttggaaaacatattagctacccactccttatatcaaaatattgcctaataatgtgttttgttttaatccttcatgaatttccaggagaactgaactgatacttgggtttgtgagatatatgaaaatagtgaacatgaacttctggtttaacccttgtgatgataatggaatcatagctctgttaattactcttgtggtttgtcttcctagagataatcatgtacaaaattcctttccaatttgttatataatattagaaatacttccaaaattggcatggatttattgttatcatttgttggcacaatcattaaaacgaaacccataaagctagataattaaatgtttacaaagctatagtactcaaaacaaaaacactgtgaaaagagattttttaaataatagtttttgcatgccttttgaataattggattattctgaatttcttcatgtttagtccctgaatctaagtcataccgtctacataaaaatagatgtcagctgaagaaaaccaggcaatggatttgtcttgacgacaatctttttatatgttcagacttcatttaacattagacttgtctgtatttgaaattggtatttctttacatttctgaatttagggaaatggcacaagagaataacattaatttcctctgcattttggcctaatcaaatttgagcctttcaagagacacagccaagtcaattcaaagagacatatgaaaagactactgttaatgtatctttaaaatgaattagcggcatgaactgttgctaggtgagttaggtatagttgtagtttttagtaaccctaagagaagatgcagtgcattctaaaatgtcacaaggagtttgattgctcaaaattctgggagattggctctctgcaaggcttcttgatgtcattgttcctagaggaatgttgttccagtacctatagcgattgcagccataactatttatgtgtcattgtagccattgttattactacatgcttcacatacctctactgaggtctaaagaattagtggacttcatattctggagagaacacttgaagaaccaaacagaagtttgatgtgaatctgcatatccaccattattgttcataggttctcaggattagttgagtgatgccttaaagaaagaaagtcagatgataggtcttcctgctgcccgcaccacatcatgagtgttattcctatagaggaggagtaaagagtgggaagaaaatgaaatctgtcaatactgtgaatatataaataataaaagtagcagtaggactgattaattctgaatcatctttatgaaatgactggagccgtgaaaatgctcagtctgcacagctgattgagaaatgtatgcaatctgttgatcggaatttatttgtgaatgctctcttccagagatttatataccagagttcttaaaacgaattttgtccccatgaaaagaaaactacagatctgtaagactgcaatttaaaatggaagaaaacatgttcccacttgaagaacaactttcaaacaaacaactgatacaaaaaagtcaaaagctgttttgttttatataatagtttcagaatacttccagtcaatatataccttggtttggtgaaaaaataaaaagctaaatccttagatcattaactagaaatttttgtaaaataaataaaagccgtgggttttagtgcagtgatcccatgaagaggaatatattcaccattggtctcttaatctcagatagaatgtacatgttactttattttataacgaaagcaactgtgttgtgatattatgtataatattataacaggagaagtcctcttagctaactcagtaatcaataacattgtacgttgtgtgttattgtaaccaaaaactatgacagaaccccatttcataagatcagtttatccacctatatgatttatatttgaatattcatttcagtacttatgttgcttaaacaaagctactgtattagtccattttcatactgctataaagaactgcccgagactgggtaatttctaaaggaaagaggtttaattgactcacagttccacatggctgggtaggcctcaggaaacttacaatcatggcagaaggtgaaggggaagcaagcatcttcttcacaaggccgcaggaaggagaagcgcccagcgaagtaggaagagccccttataaaaccatcagatcccgctatcatgagaacagcatgggagaaactgcccttatgattccattacctccacctggtctctcccttgacacgtggggattatggaggttatggggattacaatttaagatgagattgtggggtggggacacagccaagccataccaaaaactctgttttttgtttttgtttaatggaaatgatttagaactttattttctgatgtttctttttcataaaaccacgacaccaaaatctacttttcactgctccattcaactagtagagaatatctaatctcttctcaagtatttctttctcaattatggtggttttagctaagaacagcttatggcatgcttttctaaataatattagaacacataaattatctgtacctggtattaccacattcattgctcattttaagatctcaattgatacattcaattcatatatatttaaaattgattcatttagagcaagagatacaggcattttaatgtattacactgctactaaagcttagcaaattattcttttttgtgcccacaaattatcatccattcatgtcctaaaaataaaattgaatttattatactttcccatttatccaaaaaaaaggttttttttaacaattgatgcagatacacattttcaagctaaaaatatgtgtgaaagtggcctctttctcatagtatttattttaggagtctagcaataatttttcttaggttatcagcacatgtcttagcctgaattatttgaattcagtctgtgtcttcaagttcagatggttatgtgatcttgttaagatctcaaagtagtgggaatgatggagtatacaacaacctcattgttttttatggcaactgtcatttactgaaggacataaggctagcagaacatggtcagagaaggaatcaaagtttggtcagccaactctgctccacagctacaagctgctagacaggcataaatttttccaaacctacacaaagggacttagggcccttggctgagagcgacattctaaccacttccttatttatggctggtggggtttgtacattttctcatttctgtataacatttcttgactgtaataagcaatgtattcattctgctttaccactttcactaaccttaacctcaatatatactcaattaagcaattgaaaacagcagttttaatcttttgacataaatgatttcctccgaagcaaaatgctggaaatcccctcaaatgcaccttttattgatgaatacctataagcaccacctacagtcgctggaggctgacaggaaccaaacttgatgataaccactgagctgagaattttcaactcactctttttccctgtatggttcttctagctgcattatttcccactatttaaagctacagctggtgaactattcaaatatttaaactttggagaagaaaatatcaacttatcacaaccctctttttatattctaaattcatatacctgtttggtacttaaaggaaaaatatgctgaggaacaggctggtcataagactgtatagaacgtgcatcttccatcctattgaggtgactcctagacaatgggaaaaatgccttcactcgacttgctcattaaatgtgaccgtagctgctaatcttttggcgctgtctcgaactttaattagatgtgctcttctcttgaaggttggaactacagtatccagagaccatagaatcacagagttgaaaacaaaatcttggaaatcattgaatccacttatcagatgagaaaaaaaaaataagcccatggagatagccattttaaaacatatcattctatttagcctccaatgtaaaacaatgagttactatgtttcaataatgttgatgttaagaaattatttgatagcttcctcacttggtctcctatattcctccaaggttactagttaggaagactgtcattcaaatttggagactacataagaagcagaaaaagcatataaagaggcacatgaaattggaacttttctggtaaaatcttctttcttaaactctcctcaaataagctgttggtggcaggaggtgaaagacagcctccaccctttagcacagtccgtacttgtcagcatttcccaggaagggtgatgtctggaaatgatagagattgtggaagcacattgcattatgggtcaagaatgcgaaggtcaaggagtggagtcttcctttacgaagtagtgttaactgcttggcgtggcattgttgtaaacagaagccaccaggaaggatcatccttaggagggaacctgtagatatgactgaaaacaagagagatccagttttaccactctggaaacataggtaatagaaagcccaaaaggtaccttatcacttgtttgttcctttctgtacaaaaggacttaaatcctttctgagcaagaaagatatttgagaatccaattttgttttaaacttgagcttagcattttggaactattccaaagaccacagaattcacagtcattagcataccacagcagactcttttcaaatattgcaaaccagaacagtctgcttgaaaacctggaaatacgacctagtgggttcaacttgactttttttatttctaacccttacccctaggcaattattgataactcattctggtacctggtatgtatatggactttgttagaagaatttgacaactttctaatcatctgttttttttcttttgcttgatagacatacatttagtagaactttactggattgtattgattataaaccacatttcagttcatatcagtccattttgctgcacaataaacaaccaaaaaaatttaattcagtggctaataacaacaatattgatttattcatggagctgcagtttggtagggtttggccaatcatggctggaaatggtttagctatgcttatctctaggccgtcggttctgttcgggtctataccacatattttcttctgagactcaagctgaagggacatcagctactcggggtatgacagagtagcacaaggcaatgacagaagcacaaacaacacttttcaaaatctctcctcttgtcacatttgtttatagcccattagacaaaacatgtcttgtggccaagcccaaagtcaaggggtaggaaaatactttccacctatgtgaggccatggctggagcgtgaatgtatgatactactagggatgtgaaaggattgaggccaataattcaatcttctattggagacaagctcaacgagttagttaaaatggaaggctaatatttactaactttgcaacccaaggaagagaaagcaggatctctctgacgatgacggaatttcataccctcatctttgaagttatactaaagcttaggaacaaccgtcagataggactgaattgctcccccttccagattcagcatgtgaagtatgcagcatcttattatagcagtagccaaaacagccgttttcttcaatttgggaatacaatgtaggtgtgttaattttcaattaagagttctaaacttattatctgcttggtagctcttccatgtgacagtcattccatctgactcttcatgttggcttttgaactaaattttaaaggaaccgccaaaatttaagggccatgtactttttataacctgtttgtggtctgggtaagaaaataaaaattatacaactgttctttttgaccagccacaagcatgtaatgaaaatgactgttttggctagcagatgtattagaagctttcaaggtgtttaaaaaaaaaaaaaaaaactggagaaaggagccagtgaattgacctcaaacaaaacaagaacaaataaacaaaacacttgtctgcacttccaaggaagggtgatatctagaaaagatagagatgatggaagcaccttgcattatgggtcacaaacgtgaaggtcaaggggtggcgtcttcctttatgaagtagtattaactgcttggcagggcattgttgtaaaaagaatccaccagaagtgaaacaagcagcactaaaagttaaaagatttatgtgtaaacctcatctaaggcaacagaagccatttctataaaatagtataggaccttttattatatatggtcctagagtatattaaaataagtctgtttgggtccatttgcagctcatttgaagatttttataggaaaaacatcctcaaaaatatcatactacagtgccttgatgcttttttctttttataaggtactgccagcccaaatagtaagaaaccgatatgatttttgtccatgtgaggtgtttaattgcttcccaaaatatggttattgtgtagatgtcactaacgaaatatataaagagcagtatttgggaaaatttattttaataccacctttttccttttttaccctaaaagtatttatttttttcgtagcatacactctgtgtctcagtatcattgtttttcataaaaacataaattcttaacagaaaatttcctgcaagctcccctaagcttgaagagacaaaggagatttgtaatgtagctcagccccaatcagggtaaaagaatgcagggctgactttatacttataactcagaaaaaggttatgcttcccgtctcttcacagagctagtctcttaattgattccgaactaggaacatgtacaagtggcccacgatctggaacagactggcggataatggaatattgagaccttgtctatggtcagccatattaacactggataagtctgataacactgtgattacatatgtatcaatatagtatgctgttaatatattaaaaacttatttacaacatgattattggacaactgttacagtacagccacatcaatcctatatcaagttagaccatgtcaactggttttgtgttgagacacctgtgtatggacatagtctgaacttttcatagtttgtgctaaatgatagcaatcaacatcggtatggcacttacagtttactgataactttcatgcccattaacatagtaccgcaataactctgtgaagtgctgaatttgtgtcctgtttcatgattgtatttgtgttgatatctcagtcagtcagagtcccaacaagaaacagatggcacattcagattagggtaagttgaggagtctttatttacaaggcactacatactcaggattgggcagggtgtagggaaatctcacaagatagcacaagactctaggactagcagcagcagagctgtcacctctcctagacctgaagccgttgttggggagagaggtttctcagagcccagaaaaaaagaaaaaaaaaaaaaacatcatgcagattttaatgccttgggaggagcagtggctttctcttaaggacagaatttgcctcgaaatgatactcagggaaaaagagatgaagggaatcaatactctgacccaagactctcccttctctgcagtggtttgctagtcctctccttggtcaaacccaaacagaaaaccatagggcataggagtctaatgatgtaatccaagtcagccccctggaaggtggaaaaagaagggaaaatggatctggatctggagggataccaaaaaaaaaaaaaaaaaaaaaaaaccatagttggcatgcttgtttattgatattttcttgcatgatataagaatccagataaatatagtaagaggtctattttactaacaattttaggcacctaataataatactccttctttgaatgtataacctctagaattggttcagaaatgtaactgtgccgttacaatttctattagtattcaacagtagattcatatccattcatctatgactggagtatctgccatttgctggttagttactgtgtaaggtactttgtaaggtatagaaatacacttggggtgcgatggctcatgcctgtaatcccaaggatttgggaagctgaggcaggcagatcacttgagtccaggagtttgagatcagcctgggcaacatggtgaaaccccatctctacaaaaaatgcaaaaagagtacctgcgcatggtggcatgtgcctgtagtcccagctactcgggagcctgaggtagaaggatcacgtgaacccaggaagtcgaggctgcagtgagccataatggcacaactgcactccagcctggatgacagagtgagaccctatcaaaaaaaaataagaaataaatttgagctcagtgacctacattctagtgcagaaaaaaatgaccatagttgattatgagattttaaagcaataaaccacatgagacatactaatgagctcataagatcattcagaaattgtttattatgaacacatagtactttcagtgtggcattaaacagagatcactgtccttaaacaagttaaaagcagaatcaaatcatctgcaaattaacacaccactaaactttaagcttcttgagtgattctgtaatttttaaaatgtcttcagcatttcagtgtcaagatagtgcaaactcagtaaaagcttgtggaattgcattaaacaaaaccaaaataaatagattttattaaaactatatacaattgtctttctaatcatatcctctccatgaatagggaagaaataattttaggaatttaaatatcttctatcttaatagttcctcttatttccctcttaagcaatgttcactccttcaaaaatatttattgagcatctaatatgtacttaacactgtgccaggtgctgtgaagaatgccaaggaaatagaatgaacttctaattctttggagttccaattaaataacctaaagttaaattggtttcggagagaacattatgccttcgagactgtaggcttctcttgattagaaagtcttaaacattttaagtaactaaacagattaaggagaattcaaggatgcctctcactagtaaatttggattagtctggcaaacttcagaccttaaatgcaagatttttaataattaaaagaagagagaaaatgataattacatttctagagtctatgtttaccattcagccttcttaatcatttcctaagtatatctggtgatcaggattttataactccagaaaatctttctatacatcgcataaatctcttcttttaaaaagctcttcaattttgtattttgttaaaacttaaaagcctccatgaaaaatgagacaaaagtcagtgagaggctgtagcaataaaaatcagatgtgattttcttttgaataacatctgtttttacagtcctttcatgttaaactttataagaatttattataaacagctttattgacagttcaatcctatttctaaaaggatttattttcccccaatggtaagagttttcttttcttaaacctaactagttgcagatatttcagatactacatttctcattgtgtaaggtaaagtttctgaccacctgaatatgacttgtagctcctgagaacaatttgtttagtaccgatatcatgcagtgacattggtacaaaggaattttctttatttcactgtactgttttcagttttattctatagttgttaaataagaccattaaatatttttattagtcttatttcctgtttaactaggtgggtttttgatctctgttcagtaaagcattgtgctcttcagagcaagcaattgaaaagcaaatagtgagtatttctactgtaaaagtttaacattaaaagatatacacacagccaggcaaggtggctcacgactgtaatcccagcaatttgggaggctaaggcaggagaatcgcttgagcccaggagttcgagaccagtctgggaaccatagcaagactccgtctctaccaaaaaaattttttaaaaaatagttggatgtggtggaacacctctgtaatcccagctactcaggacgctgaggcaggaggattgcttgagcctgggaggtcaaggctgcaaggctgcagggagctgtgactatgctactgtactccagtctaggtgacagaatgagaccctctctctctcaattaaaaaaaaaaaaacaagatacacacacatatatttgcgtaggtaactctaatttcatttcaagtatgttatgtaacaaccatttgtgtagtgcttgtaacagtcaatatgtaaatactgactcatcttctttgacaattctacctagatacttattagagtcccccttagtcattgaaaggaaggttaaaatcaaaagacgttgtttgccaaagtaatgaaagaaaacttataaacacaatgtatcatgtctggggctgaactaaaacccttctgatatgtggtattaacagatcatctttcatgacagtaccagttattagaaataaaatgattggagttattattaatactaacaatagtggtattcttaaaatgacttccttatttatcttcacctttatacattctactactgcttcaagacccatcttgaattcttcttccacagaacattctgcattaatttcagccaacattgatttctctttttaaaatttgtcttgcacagtgaattagaaaaccaggaattggaaaaccagaaaagcttattaagtaagaagcagagaggagagagtttcaacaaagggccattctaaagtggtctactgcggacaccatactgattatagttggtgattaaatcttatctttccaactgattataaactcctccagggcatactcttatattccacaagatgcttatctgggtgcagagcatgcatgcagttggtatttgctgatttatcaactaactaaatcttaacatattattattaacaatttaaaataaagttaaatgtatcactctccacccctcaaagccatttctgttctttgttttcatagcaccattattatttcctgcatagtattttttaaaaaccgtatttttaaaatttatatatttgtttatttgggtatacttcactagattgtaagcgtcacaaaagcagaactattataaccccagccactaacacaatgcctaacaaatagtaggttctcaatatttgttgaatgaatgacctacagatattacttcattatgaaagattttgctaagttgttttacatctattttatccaaaactaaagttcttgaggcaaagcctagaatatcttctatgttctcacaatgctctgaatcagtgcttctcttaatatgcatagcaattgcctggagagcttgttaaaacatagattacttagccccaaccccagagatgctgattcagtaggtcccaggtgatgctgctgctgtcagtctctggcgcacactttgagtagtagggctctaggatgttatatgtacagacacatgctgaatagtgggctatgtgcttacttgctggctaaataataaatgttctcactgagtcatagaactttgaaatttgcaaggacttttgctattatctagtctatggatagcaaataacctgataccgtgctatagtgcttgactgcatttaacctgcagaatcctcatgagcagcccagcaccatcactccaagtgaaactactctcttcttgaggttgtccaattctatcaattaaagatgaaaaccaggttctgagagttgaaatctctggacttcaaaggtccaacagcccaggtcttctcaattctcgttagtgtttcagcagctgaatacaaatttattaagctgtatcagagtagtatctgtcaaattggagtgtccataatatgcttaaacagagaactccattccaataacatgaactttccttatgctttattcatcatcgcttgaaattttgaattttgcccaaagaagtttataccagtacatgttaaattacatcatagccttctttgtataaatcttagagtagtttactgaagtacatcgcaaagttttgttgtttcttaggtgattttaattatgtatgtttactttcagtaatgcatcttttctccttcatcaatattatgttatgctagctgtaagtacaaaataattgagaacaaattatgacaaattgaaccaagccacaaaaaaaggagaaaccaaatacttttgtgatttgagcttttttcagtccttgaaactttaagaatatctgtctttattaacttttgctttttgctgatggtttctctcattttattatagcttatagcattgtaaattaatttaacatgaaaggataaaaacgttgcttttgaaatgtttctcattaaattatgaaaaaatattacactaaataaaagaaaggaatgcctctggtaccagcttctgtttgctcaattattgcagtacccaaagtgaattattacacagttaactcagaggcaatattattgtcattatattataaaatagatgagttgcaatcttcaaaaaaaaaaaacagcataggtcctttgaaagtgaaataccttttttccttgtgcttcatttaaatatatactgaccccagttttgtttttgtttttcctttttagagttcttgctaatgatgggcccaaagttatattaagaactgcaaagtaaatttcaaccaattactttattcaggggagtcattaaattgaggtacctctgaaattttggaaggaatgtactgccaattagccgaaagcactactcaatgtcctttctatggttataatctctctagtgtatttttaattgaagacaacctctatagaggaggtgagaagttgctatttattggtacttgttaggatggaatcaagggtgtggaagatattcatctatttctctctccagctcccccacacaaaaagaatggtgcttaatccatctgaagcatttggggagcgagggtaaagatgtaatatttaccatgagccgaaacagatcttcagaagtggaaaatggaagcatattgaagtccctcaactaaacagactttcttccatatggaattcaatgcattaatgttttcaaattctatagcttcaaattcttaatattttcaaattatgtgagcttatgtcaaaacatttaagtgagcttttaacaatgaggcaaatatttgaatcatttgtctacataacaaatactactataaagcatattaaatgttataaaaatcctaatatactaatgtaagctattataaagtacaaataattaaacaatatttatatgatcaatgttttataatacgataaacacattaaataattaaaaactcttccaccgtgcaaaaatgactaaataaattgttaatttctaaggctttttgagattactgtgaaagggggtatagtttcaggaaaggtgaaacttcccttcaatgtgtaaaccattaaagaacataataacctactgagtgtgggtctcaatgatatgccctggaaagtatgggcaactactccacacccaattttgtctttatatgataaggcacagcaaataattataatgcaatggataaatggtaaatcccaccaaagattaaccaatcagagcaggatgaaaattctgagtttggaaatctattggaagatttacagattagattaaagtgcccagtaaccaaactatcaaaattatatggcttcagttaattaatgatttccaaggtttttagtatactgtattacaaaacacattaagcatcttaagcattcaaacaacatttttttgatgattcagaaagcatcacaaattgttatatcagctgataataacttaggtacatatcaattaaacttgtattatagacacgcagaattcttcagaccagaagtcgaaagggcttctctagtttgtttatgctaagttgtttagagatgacataactctgagctaatttgtctattgcaatggttctcaaaatggggggcgggggatatttttacctccaccaagtggacatttagcaatatctggaggcatttttaattattattactggattggagatacaactgaagtctagtgggtagaggccagatatggtataaaatatcctacaatgcataggatagccctccacaaggaattatttaggccaaaatgtcagtagtataaaaattgagaaatgctagtctaatatagtgtttactcacctttcctgaaactatgtcccctttcacagtaatctcaaaaagctttagaaattaaaaaatcgtttagtcatttttgcatggtggaagagcttttaattatttagtgtgttttatcttatgaaatgttgataatataaatattgtttaattatttgaactttataagagcttatattagtatattaattaggattttatttaacatttaatatgctttacaataatattcattatatagacaaacgttttatttttttcactttaacaatgatttttaactctaattacataagaaaaagtatgagttaacaattttttaaattacatgcttggtttgagggccaaatacacatgaaaatgtggactaaaatttaaaatcaaataaaatctataaagtcgaggaaaaagctacttttatgacgaggcatggggaattcttcatagtttttgggttttatcagaagttagctattttttttctttttgctctgtaaacaatcagataagagaggctcaaatgacattttcaagtacatcttaacaaaatacactttgagcatcaattgagtaaagtttcattcttttgaaactttggttttcacaagatttcctgagagttttattttattggtgttctgtgggacttgggcatcataattcttacaaactactcagctcaatctaatgtgcagcgaagctctgggaacttttgttttgtctagtatccagttggaagattctatagctacagagcttgggtttaaaccccctccaagtctttaccagctacctttatgaccctggcaaattacttaaactgtgtgccaccattttctcctctgtaatacggaggcaataaaaatttccacttttagattttctatatgcggtttacaaattgacttactctgaagatcatctggagtaaaatctggagaaatatgatcccttataacttcttcaaccctttatatatttcaacatgagtaaccaatgctctaaatatggatataaattataagaataaaaaatctaggactattataatggtctaaactctcttcatagctaaaagtgttgagtaattaaaccagttgagcagctaaatcatgtacacacttctttgatccctcccacgatcatgtatttggcattgtaatgaaaagatatgtttattttcgagaatagacataactacctttaataatatgatcacccagaaatttttacaaacccctggaaaatttcatgaatatcaggctgtgctcataaaaccttagagatgagatcacaatagactgggtcaacatatagtaatgagcaggattaataaaacctcagatgggcatttacaaatgagtcaaaaccatgagtataattaaataattgtagcaaaaaaagagccttgggtaatcctttcagcaaacgtaatcgaagtgattgcatttagaagacaaatatttaatttggtgactagaaggtcttttattattccattatgtctttgtgtgtgtgtgtgtgtgagacacttttcaaggtcaatttttacttataaattgtctctaattaaaaattgacttggttattaaatcattgaaaattggccatcatcaaattcctcattaaaatatttctatgtgccatatatatatatatatatatatagaatatatatgtagaatatatgtatacatttatttttactttttttttactgtgcctactagagaaatttaaactacatatatgtagaatatatgtatgttttaactagacatactgttaagtacactatacctaatatttggcaatattaataccatctcattgagaaacctggaatatatgcacattttggatgtctattatatgttgggcactggactagtcattgataatacagagattagtaagactcaggttgacttcagccatgttgtcaggaagcacacactctagtttgggacagcgaggagaaattcaataagagaaatatatataaggcataatgctctaggagaatatgcagtggataactgcccaataggaccaggcaaggctttttagaggaggaggtggcatttgagtcaagtgttaaaggctgaatggaaattcactggttgagataaactccttaggaggaactactttaatagaacttgccgttagtcctgaaataaatggtgtgcaaaatcattaccatctgtcaattcactcagtctactttgctcttaacttcagaaaaaaatcagaaatacaattaaaacatttgagcctattttactgtcttttaaaatgagttaattcaaagaggaaattaaatataatgagagagaatctcccccgaggattgggggctggggaaatgctattgattctttgcttgtgtttattttctctcaaaaatacattatgcataaacttgatgatcaaaaattcagattattacatttctaaattggcaatgcaatttattgcatcatacatcaatcacaaaaatgctcatcttgctgactttcataaacttctaaatgaacaaaaatgcaaaaatagtttatactatattacactatagtagatttgttaaactaaaccagaacaatggtccatgaaaaataggcctctgactccaaacgctcacaccacaggatctctctgagatttttgtgtcatttcaagtcagagaaaattgtctaataaattgttggcttgtaacaatgaaaactaagatatctgtggggctattcttgttctcttcattttactacagcagctctgcccagtagaaataaaatgtgagccacatatgtaatttaaatttctctagtaggcacactgaaaaaataaaaataaagaagtgaaattaatttcaacagtatgttgtatataacccaatatacccaaaacattgtcattttaacatgtaattgttacaaaagttattaattagattttttccgttaagtatttaaaatctggtaagttttactcttacagcgcaactcagttcagatcagccacatttcaagtgctcagtagccatatgtgtctagtggttaccatattagaaagtagtttgagagatccacattaaaccaaaaggaaaagaacttccggcccttcactgatgagtcactcttcactgctaaccttggaagcattcccaaatgtagtctacagagtttaaatagtctatcttaacatctctcagggcttcagtcttaatgccatagtatttttaaagaatggtggatattcttttttacagaacactctgtaagagcaattagaagtttatgatgcacgtaatgcaaaatacaggtcatttcccaagcctattttaaaagcgcaaaaactgtagtcatttatcacccctgagaatgttgtcttaaatgtcttggtttggatattggtgatgtgagaactttgtgataagaaagtagtctttaagaataagatatcagactaaaattcatatctagaatgaaagtcttgtttttaatggaagattaagagcaagtctgattcagatcatgcatggggtacactagtctaggaaaacactagtctgaaaatatactaaaagttacttcgcaacttaacaagaaaatgtcttgtgggtgatgtcgttcttgatttttaggcaaacctacctacctttgcaaagcagctgggacctttttgcattggaagaatcatttggagcacaaacaaaattagattatcaacactttggaaaacaactacgaatgagcaatcagaaacctgaccttaagattacttgtgaattgtgaatcagcaaaataaactcgattgttcattgctaagtgtatttcaattatcaagggccttctagattataagtagtcttttttttttacttagtttacaattaagatgtgtggtatttgaaatacatttgccacagggagaaatataaattataattaatttcctaggctaattcaatttatgacatacctatatacattatctgtcatctataatttttcccttattgtttacttcccactggaagaatgaaaatggaatattattacatggcacatggcttgatacttttacaaactctgacaattatgtatttattttgggaggcattgagtttatttgttttatttatataaatttatgaggtacaagtataattttgttacatgcatagattgtgtaatggtcacgtcaggccttttagggtatccatcaccttaataagatgcattgtacccattaagtaatttctcactctcataaaattctaattatgtgaatttaatttaatctatttaatgtgttttaggcaaatatagccggtactataaacagttgattttaagatatcattgcttacattgagactaagtaaaacaaaatgggtcaataaatgtcaatctagataacaatgtcaactaaataagaggtcaaacatggcagtatttttgaaggtgatctgtgaaagtgattatagcgtttacactcatggaaaatgccttcagagtttcaactaagaatgccaacagctcattcctttatcctgatgcatattgtcttccttctcacccccagttccttcttcccctaacccctacccgctttcctttgctgattttgacagaaataggacccccaataagtcagggagatagcaggaaatgggataggatagaacccggaatgatagaatagctgagcctgaaggcatgaagaaaggctcctcctgacatctaaatggagacctaagagatgggttggtcaggtagggggaaggaaacatgaggagtattctctaagccaggcaacatactgtgcacaagtctgaagtcatgggaaagtgattttgagaggattgctgcttggtaaacctagagtttgaattgggagagatgaagctagaaagttagtaagggtcagattttttttttttttacttgcatgacaatggtaaaaaccactaaaggttctgtgttaagcagaggagtgacttcatttaaaaaggtaaattggattgaaatgaagggcataaactgaggcaaaaatatccttcgttaagttattgaagcccagttgaacacactggtggcttaaactggagtattggtataagtgggggaaagaggttaatagattccaagttgaaaaaaaaaaaaaaaaacatagactttgctatctagtaatggattaatatacaaaaggaaaaagtaaagtttctactttttggacagctagaaaccttcaccgaagtagggaacccaagacttagattatgttgggaggggcagggtattttagttgcacagggatttgctttacagaaatgactgaatgacaatatagagagatcaattccattaaaagaagtttgattactcacagttctcaagggaagagtacatactacgccatgcaaagccatgcaggaaaaaagttccagagtcggtcagcaggcagaaaaggaaagcacagcccaaaccctttattgtggtttccaaggaaaagaaatgagtgaggtagaataggcaagtctgagcaagtttaggactggatagttcaaataatttccaaaatttcctggctgtaaaagtggtctctggttgtctggtaccaagccctagggtgaggggaaaaagttagggtgggggaaatattggtttggtgtaacaacagttagatgaagaaggtagttggggatacggactttggattagttggtttgtataacgaaaagcaatccaacaaatccacaagggagcaagtttacaagttatttgctatctttaggaattagctagccctgggaggggcagtctctccctggccttccaaggacctcaagatgttcaagcatccataaaatatggaaattttttaaaaacattataaatacacagagtaaacgctgggcatgatataggacagtggttctcaaactttagctccactggaatctcctggaaaacttgttaatatgcagatgaccgttttacccttaagcttctaattggggaggtctggggagggcacagataatttgcatttctacaaagttcttccatgattttgatgccgctggtgagggaccaggctttgagaacactgatttaggacgtgtcctgtttagggaatatccaaaaggcggacaagttcagggaatattcttgggcagttggctgtgtgagtctgaaattcaggatagaatattaagctgaaataaagatttgggagcttatctacagtcaaatgataattgaaatactgagagtacggggggagagaggtccatgtaccaagaaaagtgaaaatgactaatcccaagcctcgctgaccattgagaatggagctaagtgagaggagttaacaaagctgacccagaaaaagtcataagggccttaggaggccaaggaaaaaaaatacattcactgccaacgagaggcacttacgaatggcttgactggctttgccagcatgcatgaactgcttcataattatttgtattgattacagtaacagatacatattttaacaagcaacttaagtaatacaactgatttttaattatcttgtttaaattgataaaggttgtatatattcatggtgtacaacatgatgttttgatatacccatacattgtggaatggctaaatcaagccaattatcgtatgcattacctcacatacactttatttgtggtgagaacacttagagtatactcttagcaagtatcaagtatataatacattgctgttaactatagtatccatgttgtacaataggtctcttgaacatactcctcctgtctaattgaaattgtgtttccttcgaacaactgatttttttaaataaaaaacttaatacctgtaagttagaattcttaatggtcaccttaggagcctatacaattattcctacgttgttgttactattctgtgtctttttcttttttaacatctttaaaggtatcaaatttttatattttgaaagtagaatttattttttgtcagtctaaaatatttttatgttgaacaaaatgcatgaatggtaaacctagatgcaatcaatttttcaaataaaaaaagtagatacccatgaacatttcttttgtaattgcaaactgtcttgaaaggcagtttcaaaaagagtttagttcctaaattgtaccattactcactgcgttaaaatgcaacattcatttgagcgtataaccttttgatcaatttgtttttgatgtcttgttccctgagagttgtctcaaatagatacatataaatatacacatatctcagattggctctgagaaatgtcttgattcaaacgttcttgattctaagattcatggtacataggaactgtatggtgacaaccttgtcagcctatctttagagtagctttggattctattcagaacatttcccaaagctattctgctatcaagaatataaacaggaatagtcaagggaagctttttaaagggcaacattttcatgtaggcatttttctcacattgaaaactagtttactaaatgcagtgtattaccttctcattacaagaagtctttcacattagtataaatgcatatggcagttgtgccagaaataaattgcctctcaaactagcacatggaaagaagaattctgagatttagcacatatgtagcttttaaatagtatactctgtttcaaacattatgtgttagtccacgttctcttcagccattttcagttgcatttttactttatattcctttgtatatttatctttgctaatcattgtcctgagattcctttagctcttgaattctacgtttttaattaatagaaaactttctttttatttttcccccgacatagttgttttctagaaagaaacagttataggttataaatccaacactttagggccgacttgaacatgcatcaaagctactagaggacttgtagaaatacagattgaatggtcccatgcctagagttttacattcagttacagatagggtaggacctgagaattcacattgctcacaaatttccagttgattttgatggcattggtctagagaccaaaccctgagaaccattaaaaaacaaacaaacaaaaacaaacaaaccaaaaaaaaaactatatacagagattttcttcattggcttttgccactgaagacatttagatgaagagactccacaaagtgtaatcatttagttatgagaggggcctgataatttgcatttctatcaaattcccaggggatactattgttgctgattgagaaccacacttggtgaaacactaattaaaataccattaaaaagcaaaaacaatttaggccagcaaaacctcctaaagaatgaggcctaaagacttattttgttttatttttgccagaagcttcttatgggcaaaattatcaccaacagagctgaggttcaaacttgtgttcatagcaagcaaaagggataatttggaaaaaaagctgaggttagctttgtggttggtttgggagtgggaatgagtagggaggaagaaatttaaaaaaaaaaaaaaaaggaagaagccaaatattaaattgttcacagggcgaaaaaagagaaaaggagtaactagaaatatcttagactggttcggcaagtcgggtccctcgcagctaacagtggtcccaccctctggagtttatatgtttacattctttttttttttttttttttttttgagacagggtctcactctgttgcctaggctggagtgcaatggtatgatcacagctcactgcaacctccacctcctgggctcgggtgatccccccaacctcagcctcccaagtagcagagactacaggcaagtgccaccatgtccagctaattttttgtatttttttgcagagatggggtttcaccagttgcctaggctggtctcaatctcctaggctcaagtgatctgcccacctcagcctcccaaagtgctgggattacaggtgtgagccaccgcgcctcattggagtttgcattctagttgggaaaatagccaataaatttgtgacttattttcctttaaaaaaaaaacttattctggctattgtgtgactataggatatggaaggtgcaagagtatgaggctaacaccctgttctaaattccgtctcctctgagccttgttctgtcaagaatctcctccttctatactttttaagtcaccttcctactgatcctttgctgtcagcttaccactctggtacccttcattttaacaaacaaacaattgtccaagcttaccggtgctgctccttcacccctccacctgtacctagtgtcaattctctccctcttctgatggccaaactttgtgaaactgtagcacagctccatatgtgttcctgcaaaggacatgatctcattcctttttatggctgcagagtattccacagtgtatatgtaccacattttctttatccagtctatcactgatgggcatttgggttgattccatgtctttgctattgtgaatagtgctgcagtgaacatacgtgtgcatgtatctttaaaatagaatggtttatattcctttgggtatataaccaataatgggattgctgggtcaaatggtatttctggttctagatctttgaggagctggaagccattatcctcagcaaactaacacaggaacagaaaagcaaatatcacatgttctcacttaaaagtgggagctgaacaatgagaacacatggactcatggaggggaacaacacacactgaggcctgtcggggggtggggcgaggggagggagagcattgggaaaaatagctaatgcatgctgggcttaatatctaggtgatgggcaatagcaaagacttggaaccaacccaaatgtccaacaatgatagactggattgagaaaatgtggcacatatacaccatggaatactatgcagccataaaaaaggatgagttcatgtcctttgtagggacatggatgaagctggaaaccatcattctcagcaaactatggcaaggacaaaaaaccaaacaccacatgttctcactcacaggtgggaattgaacaatgagaacacatggacacaggaaggggaacatcacacaccagggcctgttgtggggtcgggggaggggggagggatagcatttggagatacacctaatgttaactgacgagttactgggtgcagcacaccaacatggcacatgtatacatatgtaactaaccttcacgttgtgcatatggaccctaaaacttaaagtataataataaaatatatatatatatatctctaggtgatgggttaataggtgcagcaaaccaccatggcacatgtttacctatgtaacaaacctgcacatcctgcacatgtaccacggaacttaaaataaaaattaatcatagaactttaaaaaaagaaaagaaaatgtagcagagctgcctagctcaccttctttacccacagctcacttttcagtccatttatctggctattactcctaccgtgccaggcaaactgctctcactaagaaaatcaatagcctaccccctgccaaattgcctgactcagcttctccttgtaattttctcctttagttctctaacaccctcttccccaggttttcacctgacctgtctccataggacatttgagtctctttcctgatgattcatcctcagcctcttccataataagtatggctgctccccagatcctaccctcagcacttcttcactttccatgccacatctcttctgtgatctcatcttcatccacggctctaattagtatctataagcagatgactctcaaagcatatgctgcctatgtacccctcttggccattctacattgacatctgcaactccccagtgaacttctatatttagaccacaggactggtacctgctgataagcacaggtagggtgtactgagtagtgttttctctatttggttgggcttttgctaaagcagttgtcaaatattttgagtcttactcatggccacagacattttaacattagcatgtcccaaactgaaatcccctactgcctctattctctatttcagaagatggcaccaccatctacccaattatttaagctagaaacttctgattctggtgagacttctctcttttatgcatatgtctacactgacacaaaagactgcaaattttacctcctaagtctgtcttaaagcagatttttctctatgattctctatggtttcaggcccttatcactgtgaagtcaagcatacctgattcgaatcttgtcaccgttggcaaatttttaaatctcttctagcctcagtttcctcataaagttttctgtttcttagggtgactaaagggcttaaatgagattaccatacagagagtaaggtacataaaatgcaattaataaagaatagtcactataactgctgatgatgatgctattactattcgtatcctagaaaactccggtaacttgttcactggtctttctgcatctagcatcacttcctcagccagagttatcttctgacatgaaggctgatgccgtcacccccatactcatgtttgaaattcttcaatacctttaagataaattcccacctccttggtgtagcatgcaaggtcacacatgacataatctctccaaggccccatttcttccactctccttgagtgatatatgtggcagaaaatttaaggctgcctggatattatccaccttacgtcccaatacttccatctgccgcaaagaccttctacccaacttcccatcctcaacgaattcttattctttctttaaaaataacctcaaacttcagactagacctctggtccatagggcattacaaatctctcagtaagttgtacaggatgaacacgccccctaaaactttgtttcagatatttcaatttttattttattttattattattatactttaagttttagggtacatgtgcacaatgtgcaggttagttacatatgtatacatgtgccagatatttcagtgttaaaggtttaataatcacatttacagaaaaggaattagctacaaaatggtggcactggtatacaagtatgtaaagatacagtgcttacaatttaggattattgttgtcgatgttttaatattaaaatggctaatcatacagcaaagtcgaaagaaatttacggtcaacatctgtatacccagcacctatactttgccattgaaattttactatacttgatttattacatattcatctatccatccctctttctgtgatcaatttttaatattctaatactcttacccttaaataataagttatcttttcaaaaaataatgtgtttttacatagatgaagcaaaataaacttgcccttgataaaacaatatgcactgtagtgccttctaattcagtgcattgaagtatccattaacaatataaccagagaatataaaacatgtttattaatattccactgtacctgattagatatagaccattaggaagagttattataattaagaatctaggtttgtcaatatagaaaaaaacctgtgttttttatcccactggaatgtcttgtgaggaatattgttcccctttttctaaaatttaactttgacctttattttgttaatgcaccatgggttaagccacactacgacatgtgctaaatagacctggaagttttcaaactaggtttttaaagtgtatttgacattaaatcttcataacaccttattgattaatttaaatccattaccatggtaaggaaaattcgcagacaggcaggtgaaaattaaaatagaaacaaaacaacatggtaagcaatccttccccccaagccaatcagcatgtagtcagtgtgtccttttaaattagcaaggcgcagcttcccataaagtcccagcttgattttatatgctgcaatagtattgctaaaataaaggagaaggcaacttttctctataatttttttctagaagttttcacgcagcttagtatactgcaatgaccacattactcagttccagaattagcagcattccattgtgaatgacttaattcacattgtgattactcatttaacaacattcttgagggtttacaatgtgcaaagcattacattaagtcgtgtgtggcagaggttctcaaatgcagatgatctgtgaagaagatttcctcaataagcagagaaatgagaactataaggacagaaagagagagagagagaaagagaaattatttaagcttgtagcttgtcatcctcctttcttaggacagcctaccatttaggctgagactatgtctttctgattatttcttgtggttgaaataccccttccttaacaatatgatggtaacagtggatggtaaatcttgttttgttttaatagtttacctggcaaaagtatcattttatgtctgtatcagttatatataatagtatatcagtccattaccaaaccgcctcaaaactcagtagcttaaaacagtaggtacttcttgagttcactaatttgtgggctgatggtttacattgggtagtttatctgctctgactgggctcccttgggaatctggagggtagctgagagcttaagtgtctgaaagtggctgggtcaacacagctctatcgctcacatcttgaacatccctccagcaggctaaccagcccgagcaagtcctttttgtgaaggctgaggtgaagagtggaagtgcaaacatgtaaacaatttgttgagcccctgcttccattaagcctgcaatatccgattggctaaagcaagttttatttccccctgtggtaggcagaatcatgggcccctcgaagatgttaatccccagaacctgtgaatatgctgtgctccctggcagtagggaattaatattccagacggaattaaggttgctaagcaggtgactttgagatggggagattttatggactattcagatgggcctaatctaaccacagggttcatataagtgaaaatggaagcaggagagtgggagtcagagagatgaagatagcccctgctggctttgaagatagagaaaggggccattagccaaacaatgttggtagcatctaatgctggaaaaggcagggaaatagattgtcctctaagcttcttcagaaggagtatagccctgccaacactttcattttaatccatgaaacccatttcaaacttctgacttccaaaactataagataatcaatttgtgttgttttaggccagtaagtttatggaaaattgtcacagaagcaataggaaacaaatatacgctccattgttcaatcttttgaataacacatatactattatttacttaatgtttttcttaaaatcagctcattttgttttctgcttttagccttaagtgataattcccacaaaactgtagtctgatgttgcagtgtttttttccttaatacagataaaactaaatgaatattaaaatttaaactataagctgtttatctgtgtaacatggtaaattggctccctaccactactgttcagcaaaccacattttgggaaacagcgatttaggtggttcaaaggagcaagtgattgtgcaagaacaagaatttattagagaaagaagcatttggccaatgggtagaattgttggcagacaaaggtagaagagaaagacaaattattcagtatggctctagcgaactctttgcacttttatcacacaatctgaagcttgctaatcttgacatgtcttaatgttgttggattgctcattaaactggctgaaatgttcacaaagactctcacctgtcttctggcttaagctgagatttatcacacttcttggaaacatcttctggtctccagatctccctcagctaagctatacagtcagtctgttctgtaagaaagcccaaacttctctgcagtgttcctcagtctttttgatatcatgatgaacagattaagttgatgtgttcatcatgatatcaggtaagctggccgaagactctaagctgcctaaccatcccagggctgagagggatcgatatctgaagtacctataacccaatcagggcatgtgccttagcatacccattggaaagccctgttttagagcctttatcagctgtgaacttattgaaggcaatgattttgtcctgttaatcattctattcataattttcaacaagatacgtggttgttgttaataataattgttggttgaaatgaagttaaataaatagcaattgacttttccaaggtgacgcattgcacagatttatttatcttccctttgctgccctggagtaccagttgtatctaccaataagcttcatttataggccagcctcatcttagtttctgaattagtctaagtggctctggtagcgcatcaaaaatcttgctttctgatggtctttgtaatttgaattctgtgacttacagacttggtattcaatatgtcaggaataaacctggggtgtgcccaaatggtttgaaaaatcccagccttcctgatttcctctcttctctttctcccctggccaccctaatagtctgatagtttttgttatttggatactcctaaactcttggcaatttttcttacatctgttctctacaggctgtcacaagtgagtggaggcaggatggcatgggctgcagtggaaagaccaagaaaataagttaaaagccctgggttccagtaaatgctctgtagtgggatttagggcaagtctcttaacttctctcagcatcaatctccgcatctgtgaaataagattaatgacacctgtcttgcctatacttcaaggttgttttgaggttcacatgcattttccaccccatatagcctataaatctctgatgcctacagataacctataatgttctccagtaagtttaatatttccaggattttaaaactcaatgactagcactgctctgatctaacataacatattgtgtcaatatgtgtgggagtctctctggttgatgttaatggaagtttgtatagtttacctaaaatagaataaagctataatattaatatatatcatcgatgtgttttaggtgatttttttcaatataaaggcaattttggttcaaaattaggtagaacatttaatttttactaatttacaaataaaatgataacatcaaaagggccccttcttttaaagataagttgtaactctcacattgatagtaatctgtcatttaggacagggaatccatgtagtttgaaaattcattggcatcatggagctaaaacagtggctttttaaacatgtcgatttcagttttctttgttttacaagtcaagtagtgatattactgggtacatatgaagcatactgattgaccaaaaaatagtaacaaattttgtaaacccttcacttaaccattattcacctttcccagccacataagaatcctttctctttgtccttagattaattgcctttctttaaccttttcaattctaagtccagacaagctgctgtggttctttaaaaggccacacaaaataagtattgtccagtgctaacactctgaaatgtgatattgtaattactaccaagtgaacattaatcactactagattagaatggaattacctgttatattcacattaatagcaaatgagctttccctgattgatgttgttataatgaatacaaaaggaattaatagtgatctggcactcaccaaaagaggggtagtcattaaggacatgccatcaaaaggcgggtaatactttacaaaaaacaagtattaattaaagtaatatcacaacgaatgcctattgaataacttatatccacattacaaagatattatatggttgcgattaatgtgattgcaatacattttgtaaaaattaataatgactaaccctttaaaatatttaggaagcagatatttgtttatatttgctaaatagctatgccaactctttagcttttgtgagtgacttctagcataggaacagtgatggataatatgaagcactatatataataactcatcggccgggcgcggtggctcacgcctgtaatcccagcactttgggaggccgaggcgggcggatcacgaggtcaggagatcgacaccatcctggctaacacggtgaaaccctgtctctactaaaaacacaaaaaattagccgggcgtggtggtgggcgcctgtagtcccactactcaggaggcagagcttgcagtgagccaagattgcaccactgcactccagcctgggtgacagagtgagactctgtcaaaaaaaaacaacctcatatatttttacttgaaaacatacattttgcctttaggatttttacttgttagaatatcctaaaggacctataattgtaaatgtaaaattgactaatttctgggttttaaaaaaaagtatttgaaagctgatctgctgtgaacattgaaccagatgttaagaaaaatgctagtaagaaatgagacttgggagcaaagaagcagaactaaacttttcatatatggtttctatggagtaattgagaacgtacatattaacagggatacaaagtcaggccctctcattcaagatgctttctgtctttaaaaaaaaaaaaaagtaatttttgaaattttctgtggcaacagtcccatagcagaaagcaaagagttttgaattaagtgatcagaatatcattcttataattttactacactgaacattatttagaaaattttgaatgatattaaaaccgctataaaacatacttgcctaccataagacttaggatttaagccagattaaaataaatatttatttagaaggatgtatgtaagaactggtgaaatataaatgaggtctgtatttgagttaatagtattgtgccaatgtcagtttcctagctttgatgataatgtactatgggtatttaaaatgctatcattgggagaagctgggtaaaaggtgcgtgagaagtctctgtactatatttgcaagttttgtggtcttaaaccatttcaaagtaaagttattttagaaaatatctaaatatatattttagaaagtattatctttttctctgtaactagtggctaattagctcagtctgaaagagtatgtagaggtggaactgctaaatatatttctgatctagacttacttgatgatgcttgaattagtaagtgaatgttatgtgccaacatatgctatgatacatataaatatataagattaaatgataggagctaattatttcttggcatgttgcagtgggtccatttaaaactgtttatgtaggaaactactgtaattataaaaatgagcacagcccaacagcccagtatattagttgaaatataaaaggcgttgtgtccaagatttgaaatgccttacaataagcttggcacttacttaccttcacacaaagcagacacattttattgtgattttagtgttccatattatatggtacagtaccaaaggaaaactctaaaatatgtactcaaaatcctgatgtgcccttctttccaaacaggtggcaccacaatgaatataacctttagagttaatatctgaggacaaacccagcagttacaccagcatgatttaggtcctgctgttacaattattattattgtatttatttcacaattaagttgcagagttgagctcgatatagttccagctgtggcttttttttcaactgtctcaatagttcatagatatggccaaatgttcaataatagtgaaagcttatagtccacatattatttctgtagcaccaattttatgtgaaaaaatgatttatctaaatctcagagaatttccataactagttttgttatacatctacaaaactaagttaaaagaacagagcagactttttaaatagctagattggccaaatccacctcattatcatcaagaagatactgaaacaccgtgtttatacaacaagaccaggcattgtaaaagaggaggaaaggtagagacaaaatttatttagccctcaggaatctttcattctgatagtgtaaatttgacaactttagagggacttattaacatgtatcttatatatcttgataccgaatatatattttgtgattgcattagagccatgaaatattacacaggtcatttgaacatagcattttcatagagaaggtgacatttgcaaaagattaggagaaaagtaactacgattagaaaatcgtagttttattttgtctcttgagaatgaattgatgttaattttatgtctgatttggccaaatacgatgtggaatttgctaaagactgaaaaaagaagagacatcaaatagagggttgcaagttaacagaccatgttataattaaatgagggaaaaaaaagtagagttgttaaactcccagagaagtcatttccccttggtttggtgcatttcactttggtggtgaagtaaatgaccatatgggcacttttctagctctgtccgcaggtagcactgggtatttgtggacaaattacctagcttttcatagcactagtttccttgttgatagacttcagaattctaaattccattttacatccttatttctatgtttaacttaaagataatcctttgcagccgggcacagtggctcacacctgtaatcccagcactttgggaggccgaggcaggcggatcacgaggtcaggagatcgagaccatcctggctaacatggtgaaaccccatctctactgaaaatacaaaaaatcagccgggtgttgtggtgggcgcctgtggtcccagctactcaggaggctgaggcaggaggatggcatgaatccgggaggtggagcttgcggtgagccgagatcgagtcactgcactccagcccgggcaacagagccagactctgcctcaaaaaaaaaaaaaaacaaaaaaaaaaacaaacagatcatcctttgcactggaattatcctgcagtggaggatagtaatgaaagtgtagactctgtttctgaacactagctatgtcactttcaaactgtgtgattttccttcaagtttctcaatcactccaggtctggtttctaaatagaggaataggagtagagattaatattgtgaagattaaatgagaaaacttatataaagcacttagtacggtgccctgcatattgtgaaggcttggtatgttgttagtagattcattttattatcattattaataatactgaaccctggctgttgggggaattggttctatcctcctgtctcatagtcaaaataggttaaagggccttctatctcttatttctggtggtgcattataattactaatagtaatgtgcttcatttgtatatgatcctttatagtttacatggcgctgttttatgtaatcttactaaaatttcaaaaataattttaaaaagccagaattcacaagaatgtgactcggagaagaagtagatgtttttctaagtagatctttcagtttaactgattcaaattttctcatgtttcatatacatgattatcatgtcttttgataaacagaatgttaaccagagtacaaccttgtatgaacatatttattcagcttagaaaagatccagaggtacaaaatctagatcccagtgtagaagttagcatacacagtacaatttctagtatgtccataaacaatatgttaaagtattagtttgagccatataggattgccaatatctgagtgttatagagctacaaaattagtaggaaattttgttgctttaacctaatcattaaattagaattgtgtgacttaaagttacaaatggtttccgaatattttgcagtaaaaaagtagtgaggaaaataaatataaatactaaactagacctgggaaatttaaggctataaagaattctagcttacagagagaggagtctttgtttgcaacctcccactagctaaatttaaattatcacaaatttcatcctctcctttacttaacccttgactcatgcaactagtcaaatgtctttttcttgctaattttttctttccatagatcacttatagggagttctggttaaaaatgatgtctctttaaccttcactaaaatgagaataggggaattaaaatgatatttaccacaaagagaaaaaaatctgggaggaaaaacaataaaataaaaaagataaaaaatttaggaatatgcagagaatggaggagttagcatatcttggaaacctgaattccaagtacttagaacttgggaagtcctagaaatgtgaagcaccagctactgcagaaggcagagatgaatgtgaggtaagatagtgagactgtgaagagaaatcattcagtaaaaaatgcattatcaagccaactgccactggtctagtggagtttaatcccactggggaaattctaaatggattgaagacatgtgtttaagagttagttattctttcaaaggggcaagggagctggggtatttatacacaaaatcctgctagtcattggtttaggactgcttccaacgggggaattattttcctagcatttctggcataccaccttggcaagaaaaattattttgtgtccagagtatgtctaaagccattagggaaaaaaaatgtggatcctcatagttgaaagccaggccagtctgcactaaagtggtaaggatgttttcttttagagatacaggtctaagaaagaaatctgaaggtggttacctcttatgcaagaatttaatttgatggattcaaggtgtgttggttaagagaaatggggaagggttgcttctcatgactgcggcacgattctactatactaaatttttcttttattaagcagcattgccttatgcaatgataggaaacatttgttatatgtgaaatcacttttatttttattttttaatctattcctattcttttcatttttttaacttttattttaggtttgtggggtacatgtgaaggtttattacataggcaaaccggtgtcacaggggtccgttttacattttatttcaccaccgaggtattaagccaactactcagtagttatcttttctgctcctctctctcctcccggcatctcttttaaaagaaaataatttttagcaattctttagaataagtcttggccacctaaaggtttccaggactctagttcagggagtatttatctaagtcagtagttcttaacctgatataatttcatccccagagaacatttgacagtatctcaagaaattcttggttgtcacattgggggcggggatactgctgtcatcaagtgggcagaggccagggatgctgctcaacatgttgtaatgcacaagacagccccccacaacaaagaattatttggtccaatatgtcagtagtgccaagtttcagacatcctgctctaaatcaggactgtgatgtgaattctctgcgatgatgaagatattttatatccgtgatgtgcagtactgtagcatatggctactgagcaattgaaatatagctagtgtgactgtacaccaggtgtgatgttccataccgaggaaagaagtagaaataagatatagtctttgaagtcagagctcacaatctagtagcggagacagatttttaaaaattacaatattttaaaaatattgcaatagaacatggtaatgttagaagattaataacatgctaaatttgaggcatcaggactcagacagacaattaaaaattctctgaggtgaatttccacccttagctcagaatactgtaatgtttaaaagctgttttctatacacacacacacacacacacacacacacacacacacacacccctttaaatcttttatcatgtaactcattgcttcttattttacccttttgtcagagaatacatataaaatactggaatctgatgggacattctactttatttaacaatgctattgagtttctcaaaatagtttcctaagaaagtctattaaagtattgattttttcataaaggataatacaaatggcatgagtctgtttaacattttaatcaagcttaaaattagtcttgcatttgaaacaaacttgcccagagaaattgttgagaaacttaagagaaaaacatcataaaaaattgatgggccagccaggctgtgagaatattaaaatccaaatctaaattatggttaaccattgtcacatctttctttgaagcttaagtaactcgatattccctgtaggatacccagtgattcaaagtgacacatatactgtcagctcattttccttcccagcatgctggtacaatttgtatccatagaaatatatggaaaaacctattagtcttgagtgccagaacctaccaaaaggaatctttgtcatctacaaataaattaataacataagataaacaatcctattaagttatactggcccgaaaagggaaaaaagaccagtttatgaattgacaaaagaaggtaaatgagattagccatatagcaaccactcagataataatgtgttttctctgtttagtaaaaaagcatatttgagagaaaattttcccttatagaacaattcttaataatatacatagatactcctttcctgggatgtagagtttaatcctcccctaagcccctccatgaacttggtaacttacttccagataatagaatatggaaaagtaggaataacaatggagaagaaaccaggcaggcaccaagttaactaagtagtcaagtataacatcgccagtgataataatattgatatcatgtctcctgtgatatgatgtcatgaaaaggacatgttatctctctggtattcttccccaaaacctgtaacttcttctaatagggaaaatacttcagtcaaatcttaagagacttctagaatatacctgactagtcctattcaaaagtttcaaggtcatgaagaacaagaagaaactgagagactgtcacagactagaggagaccaaaaagacccaaggaccaaatgcagtaggagattctggattggatcctgaaacagaaaaatgacatgagtggaaaaactggtgaaatctgaataaagtctgtagttttgttaatagtgttgtatcagtgtttgtttaaatgtttagataaatctctcatgcgtacagaagagttatcattaggggaagctgtgtgtcaggcacttagaaaactttcagatacataggtaccttttgtaagtaaaataatgaattaatgggtcattttatgtctgtattttatataaggctacatttctaaagagacaaaattgtgagtcccataaaaatataaaatgaatatgtgtaaaacattttattagatcattaactgatgaaggaattagtaagatgttagttacagttggttcaaaggagagtctgaagaattggcatatatatatacgtatatatacgtatatatacgtatatacatatatatacgtatatacgtatatatacgtatatacatatatgtgtatatatatattttatatatatacacatatatatataaaaaacactctagaatgctgataggaattttataacagatacaatactgatcactaactgtagggcaggaatctattgcgttccatgagaaaattttactggcatctagtgaacaagaatcatttgtgtcaccatcagccctccacaaattgacttttaaacgtacagaattgcaaaatagcataaccaaagtctaaggtacagactcttagataatcagataactcctaaggttttcctaaggaattaaagggaaagagacattctcagattaaggaaaacaaagaatttcttgctagcaaatctgctcttaaagaatgacaaaaagacattctctaaacagaaaggaaattataacgaagtcttgacatttcagaaagaaaatagtagaatgggtaaaaatgagagtaaaataatagactatcctatttaccataagtttgaagtgaaaactttaacaccacctgatgtggttctcaatgtatgtagagaaaatacttaagagttatattttaaaagaagacatacctaagtggaagtaagagtccttctacacgtcacctgaagtcaattccagtagattgcaatgttaatgcgtatcgtaatgcctggaaagaccactaaaaaactatacaaagtgatacgttaagaaaatacaacaaataaattttgatggaatcttaagaaatgttcaaataacccacaagaaggtaagaaaaaagaaagagaagaatgagaaataaagaaaacaaacagaaaccaaataaggtggcagattgaagccctaatatatccataattaccttaaatgcaaatggtctaaatataccaattaaaagagatttagctgagtggattgataaaagctgagcacacaatatgccgtctaaaagaagtttatttcaaatacaacctaggtaggttaaaattaaaagaatcgaaaaagttacattatgcaacaattaatcaaaagaaagcagcagcagtaatgttaatatcagataaagtaggcttcattgcaaagaaaattactagtgacaaacagggacattacataaagattaagtgttaattcactgggaagacataataatcctaaatgtgtttgcacctaacaacagagcttccaaatacatgaagcaaaaatgaatagagctgaaaaaagaaacagacaaatccatatttctagttagggacttcaacactcctctctcttcagttgatagaactactaaatggaaaataagcaagggtaaagagaactgaacaacaccatcaaccaataggatctaattgaagcactcctcccaacagtagcagaatacacattactttaaagctctcatgaaacattcactgatataagccatattctggactccaagcaacttcagcaaatttagagaattcaacttatatgttcccagaacataatgaaaccaagctagaaatcaataagagaaagacaaaagaaaaacctcaaaacacttggaaatgaagcagcacacctttaaatcattttccccaggtcaaggaggaggttgcaaagaaaaattttttaaacacaaagaactaaataaaatgaaaataaaacatcaacatgagtgagattctgaagcaaagggcaagcatatctactgtctatttttaaagattaagcttccttaagctcagggtttctctcctgtgatgcaatccactgtgtgtacaggtgtctcctgaacttctttgggattactctgtgggaactggctcaataaaatgttggttctttgactactgctttgctgtgagtaatctagtctttttctctggcaaaaaaaaataaagtgagatgtcataaaagcagtattgagaataaaatgtatagcattagattatttagttagaagacaggaaaggtctaaaataaataaatgagcctagagacaaaaaccatcaacaaaatattaaataacatgcgtcaaagtttaaaaaaagagtgtcataccataactaactgggatttagtattgaaggctggctcaacatttgaaagttaattagtgtaatctaccatatcaacaaactaaagaagaaaaaatcatatgattatattgattgatgcagaagcatctgacaacacccagcatccattcatgataaaaactatgagaaaactgggaatagaggataacttccacatcttaataaagggtatctacagaaaactacagttaatagcataattttaataatggaaggcttaatgtttccacccatgattgctaattagggaaggatgcccaatttcactactcttttttaacatagttctggaagttccagacactacaataaagcaaggaaaaacaataaagcatgcatattgaaaagtataaaataaaattatttctatttgtggatggcatgactgtgtacgtagaaaatatcaaatattctacaaaaacaaaagcaaaaataaccaaaaatgctcatggagctgagaagagaggttaacaagatccaaaaatacaagatcaacacaccaaagctagtcacatttttatatacagatgctcctcatcttatgatgggcttacatttagataaacccatcataaagtcaaaaaatcataaggcaagccatcacaacttacggattatctatgttggaaatgaagatgtgaaaagtgaaattaaaaacacaacaccatttataattgcttatccaaaaatgaaatacgtaggtataaatctatcatacatgtacaggatcggtatgtagaaaattataaaatgctgatgaaaggcattaaaaacaacctaaataagtggattatatggcatgtttatagactggaagagtcagcatagcaaatatgtcagttcttctcaaatcaatctaaaggtttaatttagtttctatcaaaatcttatcaaggatttctgtacacatagacaagcatactctaaaatctataagaaaagtcacaggccacagaataactaaaacagtcttttaaaaaggtaaataaagtgggagtaacctctctacccaatattatggctaacaatatagtaaggctatcaatacagtatgatgttgctggagggatagactcatagaccaaatgaaacagaatagagaacccaaaaacagacccatgcaaatgtgcccaacagatttttgataaagttgcaaaagcaattcaatagagaaagctcaccttttcaacaaatggtcctgcagaaattggacatccctagagtgggaaaaaaaaagaacttcaacctaaatctcacaccttgtaaaaacttaattcaaaatagatcatggacttaaatgtaaaacataaaactatcaaaatttagggaaaaatgagaaaatcttcaggctctagggctagaattggcattgaaagcatgatccacacacagaaaaaaatcagttggactgcatcaagatttaaaacctttgcactgcaaaagacctgtgagggaggatgaaaagacaagctacagactgatagaaaatattttcaagccatatagccaaaagatggatgtctagaatatataaagaactctcaaaactgcaaggtaaaacaagaaacaaacaatgcaattaggaaatgggcaagacacatcaagaaacgtttcaccaaaaaggatatacagatagcaaataggtgcatgaaaagattatcaaaaacattagccattagagaaatgcaaattaaaattattatatattcctacacatctatcagaatggctaaaacaaagtagttacaacaccagatgctagcaaggatgtggagaaaatggatcattcacatattgctggtggaaatgtaaaatggtacagccactgtagcaaactgtttatcaattttctgtaaaactaaacatgcagctaccatacaacccagcaattgcactcttggacatttatcttacaacctgtacaaaaatattcataccaccattattcattatagccaaaaactggaaagaacccagacggtcaacaatgaatggttgtacaaactacggtacatccatacataccaggcaatactattcagcaataaaatggaatgaaatatttatacatgcaacaacttttagatcaatctccacagaattatgctgagtaaaaacagctcatctgaaaaggttacataatgaatgattctgtttatatagccgtcttgaagtgacagaattaaagaatgaagaacagattggtgattgcaaggagtccgggacaacaggggaaagagagagagagagatggatgtgactccaaaagggcaacacaggaggcatccttgtagtgttggaactgttctttaccttgattgtgtcaatgtcaatatcctggttatgatattgtactatatttttgcaaggttttaccttcagggagacggggtcaggggtatactggttttctctgtattatttctcacaactacatgtgaacatacaattatctcaaaactaaaagtgtaatttcaaaaaacaaataaaacaattcagaaattttaagacttcaacagtcatttatctcatttgttattttactgttgagaaaacaggcacaaagaaactgaagtgacttactttcatgcttcacctaagtctttttttcttttctccatcactcagttaagagcttctgtaatacagaaagtatgtcttgtattcttttaactcccatattacttcaagcaatgttgaacacatgttaacattgtaaaagttgttgtctgagtaaatgggaaagatagaggtctatgtctatatgcaaatactttgtattaacatgtttcagtctgatataactttccacacagaaagtacaaaagaagatctgttcaagttatctgatttaattaagatagtaaaaagaaagctgataatttagggggtcttatttgattgtttttaattttacttattttccactaggtgatcattttgatgattcaaaaatgaaaatttacaaaaaggtataaaataaaaattatttctcctacctctatgcactgtcgaatcaattcccctacccaccaccaatcagtattgtcagctgtttgtatatccttcaggagatatgtacgaatttcaagcgaatatgcataagtttatgttatgtatatgtgtgtgtctgttttctatatatatgcatctttacattaatggtagcatacgatacacattttcttctgaattatgcttctctctcaacaatgtttcttggacattttcctgtatcagtacataaagaatgtatttgtttcctatgactgcaatagtgaaataccacaaactggatgacttaaccaaaagaagtctgttgtcttacagttctggaggatagaagtctgagatcaaggtgtcaggagggttggttccttctgagggctcggaaggagaatctgttccattccattcccctagtttctgatggtttgttggcaatctttggtgctccttgtcctgtagatgtctgccttcattttcacatggcatgccccctgtgtacgtgtctgtctccaacttccccttttaaggacagagtcatattggactcaggcccaaccaaatgacctcattttaagttgattatctctgtaatgaccctatctccaaatagggtcacattctgaggtaccaggggttaggacttcaacatttaaatttggagaaaatttggacagaattcaacccatagcaaagaacttaaccgttagtttaatgactacatattgttccattttgtggatgtatcataatctatttaagcagtgctctgaacattttattggttttcactttcattgttttgccttaatattggtgtctgtttcatagaatagatttatagtattttaggcttatcaagattttatttaaatcttggaatttaaattccctgtaaatttcaagtgccttgaaggcaagatatattgaggaggggagacttttaaagttcatatgaaataataaataatcgcaagtatctcaggaatgcatgaaaaataataaatgtctctgcatcaataataagggagggggcttgccttatccaatattaaacttgctgtaaagctactgtaatccaaatagtatagtattagcacaaaacaagacaagtagatcactgaagcaaaattgagagtccagaagcagatcagattgtttttggaggccgggcatggtggcttacgcctgtaatcccagcactttgggagtctgaggtgggtggattacctgaggagttcaagaccagcctagccaacttggtgaaaccccgtctctactaaaaatacaaaaattagctgggcgtggtggtgggcgcctgtagtcccagctacttgggaggctgaggcaggagaatcgcttgaacccaggaggcggaggttgcagtgagccaagatcgcaccattgtactccagcctgggcaacaagagcgaaactccatctcaaaaaataaataaataaataaataaatagatacaaattgtttttggaaacattatatggcaaatgtgttattttaattcaaggaataaaggtgttttattcaataaatggtgccagcactctttgcaattcctcttagaaaacacagattgcctcctagcttatgcaatgtaagaatacatttcaaatgcattaaagttttaaatgtaaaaacaaaaattcttggaatgaggaagacgttttctaaacaagacacaaaactcaaaagctataaggaaaaaatataccttgttactgcttaaaataacagaagacaaagtcaaaagaaaaacagcaaatagagtagatgtattcgcaacatgtgacataaagagatgcatatacctaatatacaaatttctcctacaaatttgttaattaaattaatattttttaaaattcaaacaacccagtacaaaactggccgaagtataggaatatgcaattcccagaagaggatatccagatagctggaaaaataaaactatgataatatgcttcctcatagtagtaagggataggaaaataaagaaataagacaccatgtctatctaacaaatagacagaaattaagaatgataatttttaatggaagagagcactctcagatattgcagatgaaacgcaaattgctgtggtctttgaggaaagaaatgtggtatgatctacaaaaattttaaatgcacttaccttttgatcagtcactccatttctgagaatcaatactacagaaataaaagtaccagtatgaaaggctgtatgtagaggatgtgtattttggcattgtctatgatggtcaaaaagtagaaatcaagcaaatacccttcagtgtggaaattattgaatatgttatggaattatttgggcatcccagaatgaattattatttagtctagttagagctgtgtctactgtcctgaaagaatggtgatgatatctttcaaaaatcaaaacaagtttcaattaacatattccatttttaaaataaaaaagataaaattaatcttatgggattacataaccatgaaggaggaatggagagatatatactaggttatcagtatttgttaccttggattttcaaaggagaatgaaagaggaacaaataatgtatcaagtttcacaaaaagtgaaaaggtggaatataaatattactgcaaatatataaccattgaatatgtatatggacaaggacgataagataatatagaaaactgaatatgttggttttattatgaggtggttggattgaagatatttttgtctccaaatactgttgttttaatatgttgtgttttacaaagaaacatgggctgagcagacagggaagccctgataagcatagtacctgccatgtggccattcaataaatgatagttattgattattattattagagttgtagtacagtagtgcctaccttaatatatttagattgatgcccagcagcattgagttaacccgcattttaaggacaagtgttatagctattatatactaatggtaaacttgagtctgtaactagcactgttgaaggaggacaacagagtaatatgatgtgtattggcctggggatggaagggtggtgcttaaggcacagcagattttcactccagccaggtttccttaggacctctccaatgaacaggatacctcccttcctgttctttctaccctcccaccccgttttttgctttttcagtttcagcccaaaggggaaggaagtatgatgactgactccccatcagtccctgaggtgaactgggattttgggagagtgtggcagctgcaaatttggcttcctggagataggatttttgccctcaatctggagaaagttcctgaggctacagctgttcaagcttgtgaagtaggaactttgatcccttttttcaaaagttttgtataattagcatccaacttgttagacagtatgtggctcattacaagattgccacaaattcatgctgggccgtgtctaagaacagggcaaagggagcctttggaaagtgttatacagttgaccctcaaacaatgtgagggttaggggcgctgagcccaacacattgaaaaatctaagtagaacttttcactcccccaaaacgtaactactaataggctactgttgacagaagccatactgataacataaagagtgattagcgtatactttgcattgttatatgtaatatatactgtattcttgcaataaagtaagttagagaaaatacgatgttactaagaaaatcataaggaagagaaaaatatatttactattaattaagtggaagtggatcatcatataggtcttcattctcattatcttcacgttaagtaggctgaggaggtggagggagaggaggggttggtcttgctgccaatctaaatgctgggcccagccaatgggtataagttttaagtgtgcacatattggtgaacccttacagatcacggcactgtctgttcgagtgtctattttgaaatgtccctatccgtaatataagttgcaaaggagtttgtgggcccactgaattctaccaccctgatcattgtgaagcccattcagctttgtgaagagcttatcttggtactaccttagccaaggtatgataactcagacataatgtcttttctttcatggttccttttttagtgatcatagattcagttctgtaataattagagatttatgtgtcctattagtaattgcatcattctttaaagacagtgtcaaccttgctatacagtgtgattgaagccttgacataacttgggggtttgttggcattttgaaatcccaggccccacttcaaaactgttgaatcagaatctgcattgtaagaagatccccaaaagatctgcatgcacaagccttgaaagagaagagaagccatctaacattcctcacctaagatttgaagaatttcccacttatgcaagagtaggggtgtgatttctcaggcaggatatctaacagaaaacaacacttatgaagtgtttcctgtaggagctaagcaggtggccagaaaatggcaggctacaaaggagaagaatgactaggaacctgagcaaggagaaagtctcaaagacaaggaagtggctggcagtgtcagggactaccaggcagctgaaaaagctaggtgtgaacactatttcttggagttttcagcaagtaagaggttcatgatgatgcctcaaagaatttacagtggaaccagagccaagaagtcttattgtggtgagttgggaattagggaaagtgttatacagttgaccctcaaacagtgtgagggttcggggcgctgagccctaacctcaagtaagaggttcatgatgatgcaatcaaagaatttacactggaaccagagccaagaagtctttttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccagctaatttttgtatttttagtagagacggggtttcaccgtgttagccaggatggtctcgatctcctgacctcgtgatccgcccgtctcggcctcccaaagtgctgggattacaggcgtgagccaccgcgcccggcagccaagaagtcttatggtggtgagttgagaagtagggaggtggaaataaggaatggagatgaagacatgaaaggaatttgagaaatgaggcaatagctagagaagaatataggaatacacagatccagcaacccagcaagggaagggctagattctgatttcatgagcaaattgcctactaattaaattcacaatatcagaggaaactgttggactcacttactgaataatagctgaaaagtatctttgctttatagagagatcactgtagatgaaagtcatcttccagtggtgagatattcttcagtgtcatctcttcatttttatttctaatttttcttaatttgaattatttcttctgataatgggaatgatgtggtaattttgtctctcctgtaaattattttaaagatttgtacgaactcctttggcaggcttgagtgtgttgtgacagcttggcttagatatgcattgaatgtcattgaattcaaactccttaccaacatagttagatagcccataggcattctacttgaccctttcaaggagatctggagatgcaattgtaggggaaaaaagaagaaaagaattcaagaagcaacaaagtgaaagataatttggcttgcagaagagaggtctttctatcacagtaataataatgccaattatatgtccatatatatatatacgcacacatatatatagtatatatatatacacatataactcagacataattctttcatagttctttcttttgtgcacagattcacttctgttataattacatacttatgtgacctatttgttagtaattgcttcagtttcttaaaagagcatcaccttgctgtgcaaagtgtgattgaagcctcaacatctcttgggagtttttttagaattttgaaatcccaggccccacttcagaactgttgaatcagaatccgccattgtaagacaatccccaagggatctgcacgcacgttgcagcttgagaagcactgcagtatcacacatatacacacatattcaacaccaaagagagagaaagaggtcataagctctcaggtggagactagttccatgtatatatgcatagagagaagaacaaactctaccttccagcaacgtaaaattctactcaatcatgtattcaccaaaaaagaaaaggctttctccatataatgtgtattattcatatattggcactcttcagagctcttcattccaccctaatgttatctttcttagataattcacatgacactttgttatcttccaataatttctgtcattgttataagcgaaattattcaggctttatctaagagagtaaatcaaacagtatgcctctctcattccaattctgcaatattttcattctagaatgtctaaaggagccttgaaagagaggagaagtcacctaaggccagctagaggggatatatagcagggaatggtggcaactccactcctcgtagcccagtggggttttttttttttccaatctgtatttgtatgtgagtatcacgtctatgccgattttatgtgtacatatgtaactcaaatctgttcattgtgctagttagaatcttatttccccctcttctactacactctaccctttctctttcccctcctttggcaaccaagacactgagttattaataagcagattggagcaaacattttgatgcactattgtttgatagatttgttggttcattcaataagcattaattgagcacttgctaagtgttaaacaatgtactaattgctagatttaaggatgaaaatgataaaacccttggcctctagagcctagagtgtagttggggagacaaatgggcaaattagtcacacgacaacatattccttgttaaaacagacagttgtgcataagtctgtatacccagactggagatgactctgtttccaatgttgccctgggaaacctcatgatcagtttaataatgatgtttggggtgagaggatactgagacagtttgcttctagcatagtaattacccatagaagtttggggtctttattcaaaagagtttacaggccacatgagccactgtcttgccttttataggatcacatctaagttccgtgtcatataatggccttggccttcttggctttctctgtgctctttgcctgccaataccctaattattgaagtactgtctcccgcagctcctcaaccatgagctgttcccgatcctcccagcagctatgtttctcctttcttcaaacctctttagctttttatttgtactttatttgtactaaattgtatttagagctttggagaacattcttcatagttgtaattagactgtaaagtcctgagaatgtatttttcatcttcgtagccccctgcagtatctagcagaatgcctttaaacaaatgggcagtaaataaatcccaacaaacttaaattaaatttctccaaattgcatatttaattttatagtggcatttactgataacatacattgaaataaaggccagagcataatcctctctgtttctgaatattatttatttaaatattaactttctaatccaattaggtctttcaatgacactttagatctaaatttatttttgcattgttttaaatgtcatcaaatgattcatctcttgtgttttttaatatttttggaacgaacgtgtgaaaatgagcaagtgtcatcagaatatgatgcttgggtttttttaattcaacatttctttgatcatatatttaaagactttttctcaattcctttctggatgtggcctcacaaatcatttcagaagtcaatccatttcaagatttttttttttttttttgcttttttcacttcacaggaagtcaagttcattctttaaaatgtagcaaatgattaagcaaattcaacgaatgatcttcatcaactccgaggtgtttttcccccttgaaaaatttaagttactattatttttttttctttttttttttttttgatacagagtctcactctgttacccaggctagagtgcagtggtgtgatctcggctcactgcaagctccacctcctgggttcacgccattctcctgcctcagcctcccgagcagctggtaccacaggcgcctgccaccatgtctggctaattttgtgcatttttagtagagatggggtttctccttgttagccaggatggtctcgatctcctgacctcgtgatccacccacctcggcctcccaaagtgctgggattacaggcgtgagccactgcgcccggccaattattattattttttttaaacttcacctatcataaatcttttaaaatttcacctatgataaacttcctctgtcatctggggaattacttaaatgcaatgatggccttcaagtatactaccaggcagcctatccaaatcatgaaacagaaaggctcatagaccaaattaaaatacttgaatcacagagtttattaaaatcacagtgagaagcaaacgggaaagatatgtgctaagttaacacgcttagaatagagtgtaagcagactgtgaagattagagtacttgaattctgcagtacacaacattatatgtcttgtctgtctctgtattgcatcagccttcccaattatggtgtgcttacaaggaccaaagttgacttcccaacaagggagtccaaaatgggtggtgcctgattcagtggcatgtggtttatcagagacacagagacaagaatgcatggccacagctgtaacttgccaaaatagcctgatgactagccatgtaattctcaggcagaagacttacggtgctggaataggtatcacctatggatgcctgaattaagaccttgtgaacattaagtgctcatgtgtatttatttgatcttgaatatttagtgcctcttgtatatttggtctcatgtgtatttagcatattatgaatatttagtacccaggtgcctcatgaatattgggtatcttttggtccttctatccctcactatctatgtttagtacacacatgctctgcttgctaactacttatcttctaattaacacattccaagagccaattatgtgtatctctttccactgagttcttcattcaatgacatcaagttagttgcttgaaatcagctattgtgagagcacttacaccacagaaattggcaaatgctacaattagcgccactgccctcccctagagccagttatttgacatttactagcattccactacttacatggcccttcatgctctcactccgtgtgaccactcaagccttatccctctttactgaactctacaatcaaataaaatatctttgtttcttgcttctggccctccatcaaatggctccctctcctaggaacaatctgtctctcctctatcacctttgtttagctagttaataatcccttttcagacagcacctcataaatagattcctgaacatcccaaaccggatctcctgcaccttcaatgtgctacttcagtacatttgtcttaccctttgccatatggtatttcaattgcccatgaatttgtattcctgtttagatcttaagctttgtgaggtctttttgtacttttttgtacttccgtatacctaccacataataaatatttaatgaaagcattaatgaataagtaagtgaatggagtgagtgaatgagtattcaattatgattcatttgtatcaaagtgataacatatacttacagggaaaaggccagagggggaaaaaataaaaaataataatatattttatgtatgaccttgtgtggggaaaggaacatagggccactgcctggcctgcttcttttatgcaaatcctaatgtaaaatatgatcaacgcctggctgggcagaaatacaaaaacccagtactagtgattctcccaaccagataccagctagtacagatcatagccagatttaactactgtgaagtggttaggttagaggtgacctataaggaaatgacgctaatgatcattagcatcatcttggaagcttaaaaaaatgccccagctgtaccccaagccaatgatatcagacttttgtggggaacccagatatcattgtttttaatctttaatgattccaatttagccaaagttgagtctcaacaaaccaagttcttcttactctcatattctcttcttctcgcatagataagaattaacagccagctcttctacatgtttcttagacacatatattgtttcagtggtaattcgttaacagtgcatatgtcagcaaagcatgactgaaaaaaatatctgctcccacacattctgatcccatcttgacactgcatagctgttggcgaaggcaatttcaacaatgaagaagtgggagaaatgactacattttatgtaaatatgtattcattgaaaatcaaaaggacatatgtaatgatattgtttaagattctaaatgaaggacaatacttaagagtcctctgtagtcaaatttctcagcagtaaaaaaacattgtcttttctttacaactattaaccatatggctgtgaaaatgttattctacaagcctttaagatttgaaatctgactttatgttaatacacagaatttaccacacaatcctgtatgatttctaagtagatttaaagagtagctattgctcaccttttcaacataatggtaatgatggtgcaatgtcaattacatgatactctcatgggcgtgattatatgattgttaacacactgaagtgcttatatagacatagatactgatttttatatgtacatatttaaaacaaacaaggacttaaaatggcctgtaaaagtctttctagtcagtctttctggttttggacagagaacaaataatcccttacagctgttaggttggtgcaaaagtaattgtggtctttgccattgcttttaatggtaaaaaaaacgcaattacttttgcaccaacctaatagttatctacttccatctttaacgggccctacccaagactgcatggtatataagtaagaaatgtaaatgaaaatctcaaatgctagatctgcccaggaggggaccactaatgagagaggaaatgttaacgtcccatatgaactaagctcagcttagcatttacccttcctgctattccgctagagcagtgcttctcaaaagttgacctgtaatggaatcttctgaatgcctttttaaaacgtagctggctgggccccatccccagagtttctgtgtcagttggtctgggatggggcctgagaatttgcatctctaacaagttctcaggggatgttgccggcccttgaatcacaacttaaaaacctctgctctgaagaaagggaaagctctctctgctggatttccccaagcctttttcagattttcaggagacttctgtgcggtagcttgcttccttctttccatactactactactaccactactactactacaaatagcaacctctagcatattttcagtactaaatacccagcactatatatacatcacaaaagtcccttgaggaaggtggtattatcatctccattctgcggataaggaaatagataagaaatttgctgaagatcgcagagccaaatgagactcaaacccatgtaacccatgtctgtttgactttaaagcccggaatcttaatttgttccagacaagctcattatgtgctctgatcttcaccactgaaatgttctgaatatgaggctgagggcagcagtgaggttggaaggagcagcccagaggagcaggcactgtgctggtagaatagtagtatggtggggcctgcactccctaataaaagaaggggacaatgactatttcctccttctccaaggtcgtgctgcctcccatttctctgtctgcctggtaagaagcagctctgggccatgtgtggtggctcacacttgtaatcccagtgctttgggaggctgaggcgggaggatctcttgagcccaggaaattaagaccaaccctagcaatctagtgggacttcatctctaataaaaataaaaaacttagctgggtgtggtggcacacacctataatcccaactactcaggaggctgaggtgggaggattgcttgagcttgggaagtcgaagctgcagtgagccgtggtctcaccactgcactccagcttgggcagcagggtgagaccctgtctccagaaaaacaaaaagcagcagctctgaaaagaggatctagcagtttctatatgcaggagagcatttgcgcaattgttcctggggttgaatctgagaaactcacagtgcacattcagatactatttacaatcttctaggaatagtataaatattgtggccagggcaccttcatattgtgaaacacaaaaagacttcagaccttagattatgtgtcgaaagttaggcaccaatgatttttttttccatttgttcttaagtggcaaatctttacattaacatttttggtacttgtctttagggaaatttcttctctgttctgaatgtatatattgtaattcctcatttacaattttgcctgcaaatgcaagtgagtacagatcatccagttatgaaaatgctctgagatttgagtctagctgtttcagctttaagagccctgacctagactttgaaactgacatggttttatatgtatgtggttggaattaaacccaaagcacatcttttaaaactctgaggaacttctgtgccacagctttcgctcagttggtgagattttactttgaaatttaagggatgagtctagtttatatgcaaagaaatgtagggagctttgcaaacccaatcaaatcctttgtgaacagtgtgtgcatctgtttattttgctgtcattttgagtccatgatcctgtatactgttttgtgggcacatattgagggtaatatcaaataccatgtagaacagatgctgcaggtatcctttccatgtcctcttagctttggggtggtagatgggcacatggaccaagcccaaagtgacagggtattaacaggagcaagactcaaccaataagggagagtagatgggtacaaatctcagctttctctcccctcactgggataattttgagatatattccaaagatcctcagagcatccccaacagcattgagccccagttccccagattagtaatctactcaataaatacctcttttttttttttttttcccgagatggagtctcactctgcaccctggctggagtgcagtggcacaatctcagctcactgcaacctccacctcccgagttcaagtgattctcctgcctcagcctcttgagtagctgggactacaggcatgcgccaccacacccaactaatttttgtatttttagtagagatggggtttcaccatttggccaggctggtctagaactcctgatctcaagtgatccgcccgccttggcctcccaaagtcctgggattacaggcatgagccaccacgcccagcccaataaagaactctggattgtttcttccttttcctctcctcctttcctgttccctacagtgtttcctaggatcacctcagtctgctgtatgggaaacccagactgagtcaccataacagacagaggcattgttactttaggactttagtggatatagttacatgggagagagagactgtgtatgtatatataacctttataatattaaaccatgctatactcaaattatttactggccaagatttccaatataaattggaaataaattggatataaatcaagaacagttaaaattggaaatagttaaaatacaaataaaatagctaaaattgggcaaaatacctgacccaatgctttaatatccgattgcataattaaacgagtaaagaggaaaggaaattattagcaactctatatttaaatgcaactgacatccaaggaagtcatgaagaaaactctttgtgttgataaactgaaggcctcttctagcagacttctgtgtttattgttctgttgctgactattttattccaaacaaatgaacttgcttgtcattataccccacccttccctagtacagggcccccattctttgaaacagtaactcattcagttccaaggagaatatgaaaagggagggtaatatataaaagaactgaaatgaaaagtggcctaagtgtggcacatttccattgtggattccatggcaatggagaattgatggcagagcatggtgagagatgtgaagcatcaattggctgtatctccagggaattcctgaagttcagttgccaccctggagggtggcaaatgctctctctcaccttccttgagttattgcttagatgactcaaaacaaaaaactgatgagctataaatgggctgtattatttgtttttacctgctgagtagttcagatatttcaaaataatctcaaacttaacctatggtgtggtttctgtgttaaacaaaataccgtaacttttagttgaaaatactgtgtaagcccacacaatctcttgttcacagataatcttgttgtcaaacattcatgatgacaaaaactcataaacgattcttttaaatatcaagaataacttatgctgtaagtcataatttcataagcatgaatttatgaatgtgttttgtgtttgcaattttcatttaggttgtcttaaaatcatgcgttttagcttaacttaggagaaatatatcttttgtgacaacataggatattcagagaaacgtgaaaactaggtgatgtgttttatgaaagaaggcataaagtatatcaagcataagaactttgaattctatttgtgttttttgtggctttagaaaagattgttctgggaatagagaattccatttgggaaacctagcacatacacagtagcagagttaaaatactgacttggagggttcatttgaagaattctatagaatttttgcatgttgggaataggtttatattcttaaacattgcactcagggtttctattcaaagcaaaaataactttgcatagaccttggccattctttcacattctaaagtaatccatttttttttttcagggtagttgttctcagtcctgattttctgataattcagatcatctttaatttacaccaaaaacttttagaagagtcagataataatttaacataaaatgtaaatgactgaaatatacattttttaaaggagcagatatggaggggtccaatgtacttaactatttgctctctttgtctccttgcattcacgggaatgtttctatgtagttttctaatttcacacaatttcaataatccataccctcctcatttttatgggccttcatgatactaaaaatgttaccagaaattattttgtgttagtctctttgtttagcacattcatacataagttttaacatttaactggcatatttttaaagtaatacatgttttttttttaaaaaaaatcagttatgtttgtgtgtgtgcatattttcttttgtggccaaatgttgcacgccctagtccttctatttaaacaatgagtttacataacaaatgttacatgataaacatgaagacatttagtttgaaaaaaaatgattttctagtttactcatttaaaaaaagctgaagtaaccgggaagaggagtggcagaacatattagtctttttcataatgccatcattaaacaaagatacttaatttccaggcctggtgcagtggcgcagcctgtaatcccagtactttgggaggctgaggagggcagatcacttgaggtcaggagttcgagaccagctttgccaatatggtgaaaccctgtctcaaaaaaaaaaaaaaaagaaaaagaaaaagctacataatttccaaaatgacttcagtgggacctgaggtgagggaataaaggctctggagtaatttcactctctattcctctcctaattttttttctgttcctttataacaacattttcactacttttgagcttgggagttgaggaatcatgaccagaagaaaaggaaagacgggaaagatgttcaagggtgaggatgcttaagaatgacctggcaagcttatgaaaatgcagttgtctggatcccaccacagagattctgatttagcaggtctgtggcaaggcctgcgattctgcattgctaaccagctcccaggtgatgacactcatgctggcaacctatgaaccattgagtggcactgttccagggggcagggcaatgagaaattgaagtcaaaagccccaagacctggtgctacgaaaatactctggttccttccctctcaactgatttacttgtcggtgtgattttgcaaaaatccctgaacttcttaaatcccagttacctcacctgaaaagtatgagtgttgctccagatctggaggctttcagaccatgcaaatcgaattcaaaccatgcaaaccattcaagtcattctagaaagttctgcaaggtgcctcagaggccaaagggagagatgggaagagggattgaatgggctctttccaaggttccctaacccacttgaatactttcatcttttatctctttcatatattccacttttgagtatggtttcatttagaaaataggattttataccaacagatttaaagaaaaactccaagtctgaaaatgactcatttatttaaaactgtatagaacaaagacatttagtgcacaattccaaaaattctctgatccttccacagcatgcccagtatgctgcaagagtgccagcaaacacatgcttactgctcacaaatgtgaaatttaaccccatgcactaggaggtccctagtgtggggtggttttagctaaccagactaagagagtacagggcaacatcgagcctttctctgcggtcatgtctgattcattaaaaatccagctttccccgaagatatattaattaccttctgtttcagaatttgtttttagagcctaattcttaattatatctccagccattgtgtgatttgaccattttggaactaaaaagttatcctatgaaattccacctccaactattgccacactgttagtttgtctatttcatacaccatgccaatcttagcgtggtgctagcatttcattataaccagctttcatttttaataagaccatgtgtatatgaaattgtagacttcagtctttgtatgaattgaaagctattaatcttcccagggttaggttatgttaaacagattgtaatgttcttctttttattatgttatttaaatccccttcatttcatactgcaccaatacatttctactatcttggaataaattaattccagttacgtgatggaaaattttagtgtaaaaatataacctgcagtataattttttctgtcagaataccaactagaactggtatgtttcattctaattggaaatttgagttatcgctttgatttttaacagtgggaaaggaaaatgaagattgatatctttcaatagccgttcattcattcttcattccttcattcattcacgtattaagaatagtctatgtgctaagaacagaaagagtgttagagatatgaagattaataagaccagatccctgcctgcaggcatttcctattctatgtcatagatagggggctattctgtttagaggtaaagcatgacccacattgcctctgacaagaagcataatgtctgtagcagctaactgctggagacaggaggctagagggctgccctggtaattggtattcaagtcttcaagaaaggaaaccagctattccaaaatcagtgggcaagaggaagttgtaaagttaagtgaaatgactaaaatatgaataactaaaggttggaatctggtagaaggagaggagagcatcggtcagcaccttagtttgggaaggtggtgtggccatagtaggctttatttagaaagaagcaattcttaggtaccagctaggtttcagttccttaaggggagaaaactggcaaaatataggcaggtttccagggtgcaaagccacgttctagcttcagctcaggcaaggccctggggtatgaatcaccaccagagtagcccagccaaaatgactaagggatctaagctggttgctaatgaaagaggttgcagctcaaggcagctctgctgacgcccactggatactgggattacattgatttaacacatggaaaccacttaatatggtatgtggcacaacacaattaagtactcataaatatttgcagataatgctgctgccattgctgtttttgtcgttagaagactcgggaaaatcatctaatacaggaatccatctgttggcggggcttgggcttctaatatttgactggttgatttttgtcgacccaatcttaacaatattatacacagccattacttcaggaaaggcagttgtaaagaatggtataaatttcctgtaacttgactgccacattctagctgagtcacctctatatacctcagtttctttgtatccgcagtgaagattaatgacctcatagggttgttattagaatgaagtgaattactacactggacttatttaggacagtaactcgcacatagtgagtgctcaaggaaatctcagaccctgcctgctagtggagggtccagctcctgatacatttgggggcaggtttaaggagttcattgatttagagctgtaagggctgatctttcaccctgcatgtcttcagcaactgtggctggtaaagtccagagcagtcaaaggctgacaaatccttgttagaaatcacaaatgcccattctcacaacttctgtggtgttttccatcctttccctagaatactttctttttaaggcaaaggaaagaataatcactgcagatagcacacagtatttttttgcaacatattttcaaaaattatgatgagaaaagtgtatcattcctgtgaagaaacagcataaggaaaatgatttgagaaagaaacatggttcttaaactgaaacaagtgtcagaaggaatcccagaaggcagaaggaaatatagtaatcatgatgaagtctagagctcacaccggttaacagaatggcagcagcgatattcatctcacgcctcttccatgctgtccctgagtgagcttctgctgaattgcctggctggtgaggattggtttcagcagcagaaggaatgggctgccagctgaaggctctggttctgatcctgggtagggtcagagaaagcaagatgtgaccatcacttttgaccttggtcttgaatttgattccatggaacaacgatattttacaaacccagttgaaggtttatccctttttctattcaacacagggagagtccttagagccccaggaagacttagccctttttcattctaagagtaaaccacatctaggtttccagagatgaaaagaccaggctctgatcttccttctggaagcccttgcctattcaacaagcatgagtattaaatgctattgccttggaatcataattcagttttcacagtttgggctatgtcagaaccattcttgtcaaccccctgttttctgagaacccgaaacctgcttgtttagaattttagaatctacttgactcttacaggggagaaaagatctcttttctcacccatcgctaggttcatggctgaggcacctataatgaaggacaaatcaacaacataaaagcatgcgaatttatttaatataagtttcacatgacacaggagccttcagaaatgacccaaagaatcagggaaaagtgtgtatttttatgctctgatttgaggaaaagtagatgtccagtatgactggacaaaggggaatggtaataaactggggtgaccacagcaaggcctgtttctgcagaacctcctgtgtccctgtgttttcagaggtaaaaattttcctttccttccagtatagtaagggcacctctggtatgatagtctcatgacctgcttcaggggagaagggggaaggggaaggtgagagtgaccatcctgcttctgctgtcttctcaaataccaagctgccatattgtggattttggagtagcgtaacttgaatccttttttttttttttttttgagacggagtctcaccctgtaacccaggctggagtgcaatggcacaatctcggctcactacaacctccacctcccaagttcaagtgattctcctgcctcagcctcccgagtaactgggattacaggcacatgccaccatgcctggcaaattttttgtatctttagtagagatggggtttcaccatgttagccggactggtcttgaactcctgacctcgtggtccgcccacttcggcctcccaaagtgctgagccaccgcacccagccgcatagcttgaatcttatcaataccttaaccaaatgactctgacagttttcctcttcttatctaaattcttgagggtcacccacacttcccaatgtcttttgaaacttgacctcttttctgctgaattgaggaagatacctgatttctttaacctcaccaaattcctacttcttactgttgttcattgctggctgaaaatttactttggcgagttcaccaagaacatacttatcggttcactgtttatatttgcactcaagataacacttgaggccctgctactcaaagaatttagtgacaactttcttcatcactctcatatcttatctgtcatcaagtctttttttcctcgtaaaaatgcttttagctctttaagtatgtttcatatctataatagctaagataggctaacagctataatatattaaacatccaccaaatggactattaaaatgacttaaacaaaatagaaatgtatttctttctcatgtaaacagtctaaggtgaattcatgttagttggtgttggatgtgtgtgtgggaagggaggggtgacacccacataattattcaagaatacaggccaggccaggtgcagtggctcacacctgtaatcccagcactttgggaggccaaggtgggcggatcacctgaggtcaggagctcgagaccatcctggccaacatgatgaaaccccatctctactaaaaatacaaaaaatagctaggagtggtggtgggcacctgtaatcccagctacttgggaggctgaagcaggagaatcacttgaagccgggaggcggaggttgcagtgagacaagatcatgccactgcactccagcctggcgacagagcaagactctatctaaaaaaaataaaataaaataaaaataaaaaataaaaaataaattaaaaaaaaaacaggccagcaagggtcttccatctgcaatagccaattgccgaggttgccctcctgaagatattcagccagcccaaaggggaatgagctagaggactgcacacggaggcgtcccatgtcctttgactcaaccttctactggctagaactctgccctgtggccacatgtaacagcagaggggctggaaaatgaagtctagctagatacctaaaaagaagcagagaaaggtttcaagagcatttagcaaccatatccaccttattcatgccctgccctctattcgcagtggccccgcagcactgctcaactagcttgctgcattggcctcttatctcttatctattgccttagatccatctaaatgctctgctactcttatgcctggaatatgttttcaagatgtgactaatcctctcacagcttgaaggataaaaggtcaaactgctctggtgaatgcatgatgcctggtcacctctgtagccccatcttccctgacactttcacagacagtattccctttactccaacctgtgggagtattttctaattcacaataatagcaggaaatacaatgtggaccagacacagttctgagcagtatattaactcatgcatttcttacgataactttataaggttgacagtagtagtatccctatttcacagagaaggaaagagatacagataagtaatttacatatgatctcacagatagtaagtggtacagcttgagtgcatatgactcaaagggtagaggttctagattcttaatcactgtattgtactacttctcccaatgttatcgtacatgccattccgtcttcctggaatacccttcgtctttcttcatctaacttccactcaaactttaaggatcaatttaagcatgccttattttaggtagccatggttgacatcagcctaatttaattgctactcatctatgtccccatagcgtcctttgcattcctctatatctctctgctatagcagtaaatgtaccaccattccgtaaaatccttaagggaatgtttagttttatgttcccaatgccagcacaatgtccagaacagtgttgtcccatagaaatgagagccacctatgtaatcttaagtattctagtagccacgttctttaaaagtagaagtgaaactaatattttattgaccctgatatatccaacatattattatttcaatatgtaatcaataaaaagtattaataaaatttgctttttccattctaagtctttgaaatctggcatgtgtctttcaattgcatcccatctcaatttggacaccgtattttcattgaaaatatttggtctcacctgcacacgtatgtttattgcggcactatttacagtagcaaagacttggaaccaacccaaatgtccatcaatgatagaccggattaagaaaatgtggcacatatatatcatggaatactatgcagccataaagaggatgagttcaagtcctttgtagggacgtggatgaagctggaaaccatcattctgagcaaactatcacaaggacagaaaaccaaacaccacatgttcttactcacaggcgggaattgagcaatgagaacacttggacacagggtggggaacatcacacaccagggcctgtcgtggggtggggggaggggggagggatagcgttaggagatatacctaatgtaaatgacgagttaatgggtgcagcacaccaacatggcacatgtatacatatgtaacaaacccgcacgttgtgcacatgtgccctagaacttaaagtataataaaaaaaaaagaaaatatttggtctctatttacatttcataaactttatagttgaaaaaagaagattcacattcctaagttgttccaaacatacacaaaagtttttcaataactgaaccaagagtcaatttttaaatttatatttaaatttaataaaatggaataaaaatttgttaaacttcagtctctccgtctcactagcctgatttcaattgctcggtagctacctacagccagtggctcctgtgttagacagagcagcacagccctagaacacagtagatcctaaatcgatgtttattgaagaaattaatcaatgacagtgtagaaaatttgcagtgattatgtcagaatcaatagttctccacccattttctcccacactctcaaaagggccaagttttatatcaccaaatgatattcctcttacttctttctgagcagaaacagttttggaaattaagatctttttcaaattttccagactcggcattttagcagcgtttctatttgtaccaacaatgcctttctacctattttccttgcttcttaataagttaactttgtgcgaaggtcattttgtaggtcagtgtaatattgtgcattaagggcttctaagttttctggtattataagaactccttggtttccttctacttttcagaatggaaaatcctcagagcaattttcatctaaaagtgctgcatttaggttgtttcacaattccccaaccctgagtcaaatataggttggtgtatgagcagcagtgtctcttggctaatcaagagcgtctccttttgctacgctcagtgttagagaaatggagaaagtcagctgggtttagagattaggtgagagactcaggcatatcctttgataagtcataaatcatttcctgtttagaaaagcacatgtttagacacccataaaatctccaaatgaagggtgttttacttttccttcaaaatctcactgggaaaaggtacttctgactttccaagtgaataaaaataatgactcctgattaccatgtatgtttaaactgatttgcaaagcaagtgaaaaagagtctagtgagtagtgataagcatcttttagacatcagaagatgtactgatttaaaggtccgtatcattttataactagtatctattgagattcaaatggttattactctgtgtgaatctgtcttttctaattgtttttacttattttagaatatcgatttgtgaatattaaattcctaagttttccagcaatccagtgtttgttttggatatccagcctggatgcagaatagctgcagaaagttatcacaaattgatctctatattctgtttccgagtggcaattgtcaaaaatttggggtcatcggctacccctcccacccctaagaagttccttgtacttcctctttcaaaacactcacatcattgttcagtgcctcacttctctactaaaatgtaaccaaccacaaagatagggactatgtctttcctgtttactggtggattctcagtatctagcaccatgaccaatgttaatagacgttgaatcaattccagttgttacctcttcacactgggacaaaagtccttgcaagtattctgctgccatttgtatagattcaagccaaatatgtctcaaaacgatattacagatgatctcttcgttgttcctctgacaatttctttcccccctgcattgcttaacttgattgacaatgacccctactacttataacatgtgccttttaggtagtgcacttggcactacattttatgtgatagttttatgatgctaaagactatttgctgtgatgatgctgtgttctcacatggcatatccagatttatttatgctggtgaccaaaggcaggtagttaaccttgaaaataggttaaaatttgaaaggcagcaaatcttagggctagaatttataatttatctttaaggaatcttgaaaccaggtgtgaaggaagggacgtaggctagaagtacagaaacctgggttctgctccagcactgatgttaagagcaagttgcattgcttttctggaccttaattttctcttctggaaaatgaatagattaactggaacaaggaaggaaaatacgtgaatggcttccgtttctgtctcgtttacccctgaaagacatggctagtcagtcagctctgtatcagagcacttctcaaggcaatgctccaggtagctaccactcactaatgagagttagcacataggtaaaacctctttgtcatctctaggctacttcatgtttaagatactctccagctttaaaattctaataactctattagactgaaatttaagaatacgagaataatcatccctcaccatgaagagagagtctgaggaaaaaataatgagaacgaataacccttctcttttactacaattcaggactgccatgaagagccgtccagattgtgaaacatacaactcatgatgtgaatggtacttctttgtttttctcggtgtacaacttgcacagctgttcatggccctctgcttccacaaattcatttctaaatagctgtacctcagttctttgacttctagtatgtctaatttaatacacatttctagatttacgatatataagaaatatctccatgaaggaaaaatgtaatagcccatgcttttcattataatagaattttatgaaacaatgtcttttaaaaacagaaacatatgtactactacttcgcaggacattagcccttgtatataaatcaataatacaaaaaattcaaattaccaaggattagaaaagactgctgtgggatatcttctggtgcaagcatacagttatttatccatttctttcatgaatatttattgatgttccaaacattaggctagacactagagacacatcaataaataaaggaaataggtttgatctctatcttctttgatctgtagtttagtgggggaggaaggaaattaaacaagtaactactacaggttgaacatccctgatccaaaaacctgaaatccaaatgttccaaattccaaaactgtttgaatgctgacatgacatcacaaatggaaaactccacttctgacctcatgtgacaagtcacagtgaaaatgcaggcacaccacatagagtttattcagcatccccaagggaagaaagatcctctcagcccccgttagctgtgatatatcttttccacccacacccagattccatcatacaagcaaacccacaaaaggtacgaaaaatggcacatgtgcgggctagacgcgacaacggcaggtaccctacaatgtccagcatggggccaaaacctacgtgcattaatcactgtgtttgctggtatattctctggtggtgtcaagatattgttgaaaatgccctaaaggcctgcatgatatccatagggtaatgcaaatattccaaaacctgaaatttgaaatactttcagtcgcaagtattttggatatgagatattcaacctatagatggtaagggtattactatgatagtgctacgggtgtacatcaaggtaattgaccctggcttggcaggatgcagaaggctttcccaaggaagccttacctcagctgagacctgaagagaagcaggagttagacaggtcaagttggggatttggaggaggtggagtcccagcagatggaatactatgcataaaggcctggaagtgagaaagtcatgtcatgttatttcaagggactagaggaagcttagcaaactggaggcaagaagatagcttcagcacactattgaaattgtccaggtgagtaatgatgatagtgtaactaagttgtgatacctaggtatgtgagctgaacctatggagaaatgttctaggctagagaatctttaattggatatttaattatcagtatatacgtaattaaaaccttgcaagggtttgaaatggttcagagtaaagttcgtagatgagaagagggcctaggagtgaacccaggaaaatggcaaagtttcaggggtaaataaagaaaaataagctttcagtggagacagggaaatttgcagttcagtagataggagacagactaggttcgtgtgatgtcacagaatccaagggaagagaggttttcaagaaaaagtaacatttagaggtgtcaaatactacaaaagcatcatgaaagataagaccaaaatatatcctattaatttagcaacaaggaaggtattgacaacctttatgcaagtgatttcagtgttgattatggagaactcagtaattacttggtggtaactaaagaaccaagattgcagtacgttcaggcatgattgagaattgagaaagtgggggagcaagtgtaaaacaattattttaagacttttggctgcgatgggaagagagaaagggccatagtagcagaagatggatgtaggggcaggaagaacacactcttaaaagggtagtgacttacacatgtttaaatggcaatgagaagaagatggtagagagggagaggttgaggatgcaggagaaattagagataatcaatagcacaggtacttgagaaggcagaaagatgaaatttagaaattagcttcagataggaaggaaagtacagcttctattacaacatcaggggagaagggaaggaggatgggcatagctactggtagttttgtaagtttggtgaaaggttaagtaggattgttgtattggatttattttttattgaagtggaagctgcagctaaatgcccagtgatgaggaaggtgttggagtctgagatttaaggtgagtggcaatttgaaatagctgctctaggatcctatttaacagagaaaatgttgagtacacaatcagtgagcagttttaagtccactctattctgtttgcagtttcaagtacctttcattgcttctaagtttatgaaaactggttcacaatcttcttgtgcttcttatttctacctcttttccttctgttttctcacctccccagtttaaacagtcccgaattttttacaattaaatatacagcaactgccatgaaatctactgataaaagatactgcaaaatcagtttgggattgggttcattagcttacttattattatcaatcctaggccactaagcaaccttgcataaaatgcataaaatgaggagattctagtggaggatagttttcaattatctcattaatttcaggccatgtgactagtccaaatagatattataggccaagaagagcctatcttgagattttaactcccaggataggttttctacctgatcaaaagaatctaataactattcaatctcttcttaaatggtttggttttctgtgcaaacagttttacccttttagctgattttctaggtgttaaattaagaaaattctctcagatacttgttcatcatgtactaggatccctgatgtgttcagagttgtccaactttcaaagggctttgcattcagagtacctaatctaaaccctgatatcattcttttataacagaaaaccccggattagactgggacagtgtctgtcatgttcatcactgcatctccctcagtatttgtagaatgaatgaagggacaatggcaaactatagtcctaccatcacacttttggtagtgaggagaactgctgtaacttggaagattggagggggaaaaggtggctaaaacaatcatacagtaaactgggctgctatcaagagaaaccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttagtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagtttttaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggagttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaaatattgattattgccacaatttcagagcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaactcgacctttctctctggctgcccttaacattttttccttcatttcaacttggtgaatctgacaattatgtgtcttggagttgctcttctcgaggagtatctttgtggcgttctctgtatttcctgaatctgaacgttggcctgccttactagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattcgttattctagttatacattcttctaaatttttttcaaagtttttcaaaagcaatggcaacaaaagccaaaattgacaaatgggatctaattaaactcaagagcttctgcacagcaaaagaaactaccatcagagtgaacaggcaacctacaacatgggagaaaatttccgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatccaccatggaatactatgcagccataaaaaatgatgagttcatgtccgttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaattaaaaaaaaaaaaaaaaaaaaaagagaaaccagtgctctattatctaggtatataccaaggttacccactgcttgactctcattattagccttctttgatgttctctggtacttgatgtctttcataactaatcaatgtattaatgtatccaatcatttactcgataactttattgaaagcaaaagcagttgcataccagctatcaagctggaagtgggagatacagccgcagacaaggcagatatggtcccagcccttaggagctcccagagtagcaggaggtttccccttccagtgtcttctctctgcttttcttcaaaaggaaaaggctgatgtgtataatataccatatctctttgaagttctctgattatggattttaggtttaaaccagttcttcatccatgactttataaattgaaaatccaggattttgctgtgttgttgtgttcttgttttgttttgatgtccctgttttctctagatacagttagaaatgtctaggaagaaatttttggttagtatgggagccccacaaagccatttttttaaacataaaatctgtattacatatcaggtatgaaatacagggggaatgaatcatttctccgtaaaggaaaatttaaagtaaatttcaggaaagtgaattctttcccgtttgcattaccgacagatgcagaaactttaatcgtcatttgctaagagggatatggcagataatacacaatagatgtcgtagcaacattcactcgcattctttttttttttttttaaagaaatctttctttcaagaagctattctaggatctttctcatgacagtgtcctagttcttatctttgctacacacaggctcacaaagtgttttctttgaagggcattttgttattggccctcttttcatttttcttttccgtagcaaacagaaccgaaggtgtttactccccacggtgagagggcacctgggtgcacaaacagtggtgtgaaccactggcctttctctgctttccgttccctgaatgtaagaaacaggtgcagtgatcaattcactgcgtgcagtgaaccccaggcagaaagagaacgtcgtgtcacagaccttttgttacttggagagaatgagcgggaagaaaggctgcctctgctgctactgagacccttttgcccattttattgactgctataggttcatctatcctaatttgtctccggctgtcccagtttatccctgttattcttgtgttactttactttactatattttattttattttattttatttattttagagacagagtcttgctctgtcacccaggctggagtggagtggcatgatcatagctcactgcagcctcaaactcctgagctcaagcaatcctcctccttcagcctactgagtagccaggattatagctgtgcaccactatgcccacctaattttttttttttttgaaatggagtctcgctctgtcacccaagctgcagtgcagtggtgcgatctcggctcactgcaacctccacctcccgggttcaagcgattctcctgcctcagcctcctgagtagctgggattacaggtgcccaccaccatgccctgctaatttttgtatttttagtagagacagagtttcgccatgttggccaggctgttctcaaactcctttaactgtttttttatttttatttttaatttttaaaacatattgtagagataagagtcatgctacattgcccaggctgatctcaaactcctggcttcaagcaatactcctacctcggcctcccaaagcacctggattacaggcatgagccagtgtgcctgaccctgtgtgattattattagcatcctggacactctcaaaagtgttcaggtttggacaatgaactataggatcaccctaattacatgagattaagagtagagaccttgaccaccagaaatggtcaatactcaccatatattttcttcctgatgttagaacctggtacttttgggaaatgaaattgtacatgagatatatgcagaatgggcgaagggagcgaaaagatttaaaaaattaagctcgatttattgagcgcctcgagtgcgctcagtgctgttccaagtgctgacagcagagaggtaagttctgttctccagtgttcacctcacacgtgcaagccaggtttgaaaacacactgtctttccttagtatccctccacccctccatgtgactatacgtatgtatcaagtttgtgatatttcacttctgggcttcttttcatttggaaatttaatgtcagtgtatcatgttttaattaataggacatcatgttatgaaactgttgaatcgaatattttccctaggcatcaaattacttgtcagtggaaatttgacatctagatatgagggacaaaagagatgagaaaaataatagtaaagtgttcctaaaggatgctggtatactgtttaggtattttaatgcactgttacaacctaaagtgtcttgtaaagtatgttctttagaaataaaataaataaaacaagacatctctccataggtacaaatccacttgccttcctcaattcctatccttctgtgatgggaaatctctgctgtgacaaagaaccatgttaagaaaaccataaagttgtattgtttgtagatttttttaatgactaaaggaagatattgcaagtagtagaaacaaatagaggaggtggccctgaaggtcaatataacggagttcactgcagaaaagagaaactactctaggtacgttagacacatatcaaagttttggaaaggctaaagtagcaggttttagacttggcttcgaggacagatttctaaaactatatagaactgatccaataagaaactaccatctccggggtaccactgaagcaatgatttcaagaacatactttgtaaataggaactaggaaccaggaggttgaaatctagacgctaccacttttgaagctgctgttagcaactgcccttctccagccaggaagctggagaaagaactttggaactctgatgtaggaaatctcatgtttctttgactaagctcgccaacagaaatagccaaaaggggcagaaaggtgacctatgcctcacttccactttccagatctctcacaagtatacacatttggcaaaacgttgccagatttagcaaataaaaataatgcatgcaacatacttaacactaaataaaaaaagattgtgtagaaaatttaaatttaactgggtgccttgtattttatctgacaaccctaacttattatatcctaattcataatcagaacactagctgcatggaagtctggcaaatacagtttttaatttccaacctgtccaactggaaggatggtaagtagatttaggtgagccagttcacagtattaaccaaagtagattgcctaccaagaatagctaaagcctttctgcccccagacgcttatgctaccatctgaatatttttactttgcattcttatattcttggaaatcctatcaatctgtgattcagattggtttggtttaactcagcttccccttttttttggagacagggtcataccctgtcacccaggctggagtgcagtggcacaatcatggctcactgcaacttcgacatccctgggctcaggtgatcctccctcccacctcagcctcccaagtggctgggactacaggcacgtgccaccacaccccgctactttttgtattttctgtagaaacagagtttcgccacattgcctaagctggtctcagattcctgggctgaagtgatccacccaccttggcctgacaacgtgctggaattacagatgtgagccaccatgcccagcccctctttttaaaatataaaaatctcccagaatgtgaaagttgtcagtctatactttgggaataagattttcaacagatagaagagaatgaggattaaaacataaggaagtttgggagtagaaaatatgggcaccagaaggtggaaggagagagcagatgcccatttatatatctcctttgttgggtgttggacaaatccaggtcttaaaataggaagtatttcttttccgtacttcttgaatctttcatatcccaaaagatgcatatttcccaaatcatataacccaaagtcatgctatcaaaatgatataaatcatccatggtataggttaaatagctatatatgtatatgctggtctgagacatgtatatgactattgtgtccatggaaatttgagtttggggttctggaccatttatttgcaagtgatttttggttagagaactctttgtaagttggggattgcttttacttattttatgagtaaagatgtcaaaaggatgactgctaaatttgcactgtgttaattcactatttagtgagaagaaatattagactagctatgaaaagtaaaactgcctctccaaaaagtcaaagctgatgaaaaacagtcatacaagcacaatgccgctcttcggaaacatggaaacactttttccttcccaattttccctcagattttctcttccgcatttaaaacacttgggtggttcaagtttctaggctaccactgattgtaacagcaaacagtagcaactggaagcagtgggatgttgggagaagtaatagaggtagctgctacccaagttatcctggaggattttccatggcaatgaaatcaggtagtagaagcttggctaactgagtgtaagcaaacagttctactgagaatggtgttgtcttttcaatccgtttatctgtgatggtgatagtgtgaaacaggggaattttatccaaggtttaaggaaggttatttggttaaaagaggatattgttacagtgaagtcaaactttccattaactttttgctgtaacaacagattgaacgtagcatttcaccgtcaacgagtaaagtgaaatttacagattaacttatgtgcctcttttaaaatatatcagatttctaaattgcttttatttcagaggtatgggaggttcactttctctttgaaagtgtacattatttttctagtgtcttacatctgcctacaaagatgttattttacttgaaagcacagtaactatttgatgagaatttgtcagcatcagtaaattaaagaccctcaaatgatttctactaattatagtttaattccgtacatttaatgatattttaaaacacatgagttatttcataactcccaacatcacaaggataaattttattctacaaacaaaatattgtgctaaatgaaatagttcatttaggcaaagaaaggagcacagaaaattagtggaactctctgctgtaagtaacgtagacattacatggcatattgagtctccatgaatattgtcatgttatgttttaaaaaggtgatcgaacatatggcatttaaaagttccaagtcctcttttaaatgcttcagaatctattatttaatgatcatcttggatctcaaaactgatcttttgaaagattttattcgccccatgtgttaatatgatttccctgtcatatgatatgattatctatcaatacttaaaaccagcagccaagtaaaaaatcagttcatatcatttaatgaatactatgagtcaggatctgggtaggcaagctattttcgggtttgagtagttccaaagcttaaaaatcttatattgattttacagtgaagaagaaatagtcttagctactttggaggtttcaaacattgactactcaaggagtatttccttgctttctcaggcaccaggcagtttttcaggagcaagcattcatccattcagggaattgtaacctgtagtttccacttttctagcaatcacacttaaaaccatgagagtaggccataggacataaggagctcagcttctcagggcaagcacatcctttcagctttcacctgtccgtttgttagtgttcacttccgtgctcaaggagtttcttgttgcctctgagttctaagagacagaacgaagggagaagggtgcagaagtctaacgcatgttcatggacttatctctccaataaagagcttgttttatcttcttttatttatttattttttctaatgaagccattagcctcaaacaaagccatggaatcttatcagagtgaaaccggggtcattccataggctggctgagtgagagctccatggcacgatgatgtatggtcactgcacaacaacgcctttgccacaacacatgtgccttttaattacactttaaatctcatttgaagagatgttatcattatggaaattgctctgtaaatgtgcccaggatgagacccaataaaagtttgctgagaagaattgaagacagaggagatgaatcagcagctaaaacattaccatcagacagaattttcttggctgtaggcaaaacagcccatgcaataacagaaaatcttcattgactcagaggcgtattttccctagattattatggggcactcctgcctgtagcactatcacttctttgataagctgaaggaagcgttctgctctccagctcagcgggcctttttctccccaacctcagagccatcatttgaatttatagttgccaaaatgaataatacagtattgcccttgtgttcctgacttcatgcatgcatgcagagcggggttaaggttctttaaatgaaagattgccttctattcatgcaataaagaacacctctgcttcctttccagggtcatttaaaaataactataccgctgggctatggaaagcacataagaaagattcttagggtaaagtcaaaatgctcttttctctacaacaggcattgtctcatatctttgtgtagcacagctgatttgaagttttcttttaagcacattcttaattatcttttcctttgatcttgaactgtttccctgggctaccagacagagagcctagagccctacctccgctttccccgaggtgcaaactgctccgtccttccacaggcaggcccctggctgaatgcacccttttctccatggttacccacccacctctctgttatttgttacttcccaagtgaatggcaggttaaaatgggaaaaggtcaggttatctgaatgtggttagagtgaaatgaatttcctcattgcacccaagaactgtcctttgacaggtctccttccccaaatcgggtcattttgtacgtaggctcactgggagtaattctaagacaactaaataagtaaaatcacattttggtgccattttccaatgtattcttcttcttgggggttctcctttaaaatggtactggaaggatacgttgtcttcattaatccattgtatgtcccgggggtggaggtggaggtggcagtagcagaagcccgtgaagtaataggtcgtattttgtgtttataaatatttctgcaggtttttgaggagaagatccatcattcttataaaggcattcatgacctccagaagattaagggctgttatgctagaacagtgtttcattcttaaaatggggtctctggactagcagtatcggcatcacttgggaacttctaagaaatgcaaattcttgagttctaccccagacatacagaatcatgatctctcagagtggagcccagcagcctgtgttttaatgagccctctgggtgattctcaagcccactcaagtttgagaaccactgtactaagggaactactgatgcatgatgcaagttcacgctcacaggcacgtgtgaatgacacaaagaacacagacgcctgagagagcaagaaagacaacatagactgtctgactccctgctgggcccttctttaccgcccctatttcaggctaccatgcccatgagtggatgacacgtaccccccgacaaaggtcaacaccactctcccttccacaccctatcactaagtgacaggctaagcctatgttaaactgctcacatctccttggaaattcaacactttaataataggtagcattatcacccccatcttcttctctaagccagaaacccaacttgcctccctatatgttatccttgcattcagtcagtctctaagttgtattcatgatctctcaaaaatatctccctttttctcatcctgtgtctattacctcagtttagatctccatattctcttgcctctaatgttcttgcctctaatgtaccttttcactgccaccaagatgatgttaccaaaaaatcttaaacagattagacatcttcacaggataaagtccaaacccttagcttgatacacaagccccttcacaatccaggccctccttcctgtgcagctatatatatatatatatatatatagagagagagagagagagagagagagagagagagagagaaattttgatcttaccactctgtctctcttcccgccatgggtcttcccctcttccctccggagttacttagctctgatgtgtattcttatctcgtcttatcttcaacttcattcatgtttttcccactgcttcaaatttcactctcccacttctcccctggccagctgctactcatccctcaagaccctgatcaaatatcatcacttgtatgatggcatctgcaaatcttggggggcaaggctaattgttctttgttcccacagggctgtgttccagtttaacatgatcacatgttattttggttcatttatttgcttaagactttttcagaaggctatgggctctttaaaatagagaacttacatcttgtagttttaagagtatttttagtaaaagtttagagtgacccccatctttctgccagcccacaaaaggaaaacatcaaaaagtgaatgtgtaaaaggaagagaactctgacaaaaccaggcagaaaggtttttcagcaagtctttttattttctgttcaggataacattaataattatccacgttggtttctcattctcctgttggtgaatatttttctgctaaatttaaaaccgtatcacaaactcaagcagagatttacaacatttcaacagcttttctacccctgccttagaagggtggatcaaaaacatttgtccatggtaaagcactatggacatgacttagttaacaattctctgtttgggtcaccatgaggcttcttcgtttatactcagggtcagcgacaatgctgatatgcagctacaatttctcatttcttactcagggtgttatgaagcagatttccactgttctttaatcgttattaaaatgtagtccaggtgcagtggctcacgcctataatcccagcactttgggaagctgaggcaggtgggtcacataaggttaggagttcgacaccagcctggccaacatggtgaaaccctgtctctactaaaaataaaaaaactggccgggcatggtggcaggtgcctgtaatcccagctactcaggaggctgaggcaggagaatcgcttgaacccaggagggggacagaggttgcagtgagccgagatcacaccattgcactccagcctgggcgacaagagcaaaactctgtctcaaaaaaaaaaaaaagtcattctcatgtaaaaattcttgtaaaataatctgtaaagtcatcctcttatctgttctagttcttcataagacttatataacatgtcatatgggcatggaaaggcctaagccttcccaaaccttgctcttttggggatgattttccaaatgtacttgttctcagttgaaaagagcattgcggccgggcgcggtggctcaacgcctgtaatcccagcactttgggaggctgaggtgggcagatcacgaggtcaggagatcgagaccatcctggctaacatggtgacaccccgtatctacttaaaatacaaaaaattagccgggcgtggtggcgggcgcctgtagtcccagctacttgggaggctgaggcaggagaatggcgtgaacccgggaggtggagcttgcagtgagccgagatcgcgccactgcactccagcctgggcaacagagcaagactccgtctcaaaaaaaaagaagaagaaaagaacattgcatcatggcacaaggacacaaaaaataccctggacctgcttcagtgagatggtctaagggtctctagcatcttctgaactgaactgaatgctttgggaagaattaatagatacacgatgtatattagttcgtttcacactgctataaagaacttccctgagactggggtaatttatttaaagaaaaagaggtttagttgactcacagttctgtgtggctggggaggcctcaggaaacttataatcatggtggaaagcaaaggggaaggaagcaccttcacaaggcagcaggagagagagagaaagagtgaatgggaagagccccttataaaaccatcaaatctcatgagaactcactcactatcacatgggaaaacagcatgggggaagccacccccatgatccaatcacctcccaccaggttcccccggattacagttctagatgagatttgggtgaggacacaaagccaaaccatatcacaatggaaagctcatgaatgggttctaagaatgaggaaatgtaccttagcattttgcctacttttcctttatgacatttttttcccggcaaatatgccaaatattacctacctttacatcagtgtccacatgcatatcccctgtcttcctccttttcctcatacattaacaaaagagtaactttgttttctccccatcactgttcaccctattgtataagagaagaaaagcaaaataggatgaaagaactatctaggcacacacacaaaagtcacactctccagaagaaagaatttgctctacttggtagtagacagaaattaactcactgaagatcaccagagaatcagatccaattatatcagcaggactttagtttacatcatggtactagaaccttctttaacattcaaaacttatgaatacctagaaatagttttaaggttaatatctctatgctgtgggctaaagagtacccacaaatgaatacagttgtgtctgatgagtgtctgtgattattttggaaattgtcctgctatttaaaatgaaaaaaatagaaatgtcttagattttcctatcattaacctattgtaaacaattacatcagtgtagggttgttttgtggttgcgtgggagtattttgaggtttttagggggtaaagtgggggatagaatgaagttgttgtttgcatttacaaccctaataattaaaacaagccagagggaattacctacatggctgttgtgatttctagtgtatgatcaaaaataattatggcactttgccatatgttcttgctttcttcttagatatgtgttattgggaaaagatgagacttgacatcaactaattgcttttttctaatatacaaccttgaaccacagtgattctctggaggacaaaaaatagcttagtgacaaagagattccagaaataagagcttttcgagcttttaactctctatgtaatatagacaaattgcacagattaatataaccaaatatgtattggtccatgggaagagagttacctatttgaagaataggagtgtattgtgttcatttagaaccattcagaaacatcaatgatattagttctgagttgactaaggataaatttttaaaagcaatacctaattggaaaattattcagttgttgaccattcctatcagtgctctgaaactaaatatctcacagatgccttaatgagttattataattatgttgctgtgatacatgtagcccaagtcagaagtcacttgctttgtatttaatggatggggaagacactggagcttggagggaagagaataaaaataacctagtttcaggaagatctatgctctaaccctgcttctgccacataacaacaactctatgatttgtataagttactttacctctcaaactcgtggtttcctcgataggggataaagaaggcctatttcatagagttggtgtaaaggatttataagggctgtaagtattagttcctgccctgtttcatccccctaccctacccccacccctcatcatggctctgcaaaaacaaatatgtctcagagttggaaagacccatctggtctttctcagataagggtagttttcttcaaacagactgattcctgcacataaaatataatataaaaaaccaaaagtaccttcaacattgtagacttttcatatgtggttgtctctgtgacttaaatgtacaatctagggtttgcatgttaaggtctttcaagattactgttggcactgatctgaaagatgtctcatgcaggaaatgctcacccaattatgagcactgaggctgtatagcaatatcagaaataatattgcagcacagtattttctatggattttagatgcagtattaaaaaaagaaaactcagcctgtctttaagactcgttttctctttcaacaccagaattaaaaggcatgccattcttttttaaagtttatgtgcagagccaaatgaatatcaacattagttctccactgggtccacggcttctttttaaaaatatctgaagcagtgttactctacccactttttctcaggaaattgtgtcctttagaactggcacccatatagtttaggaatgcttgatagggtatattttaggtgggagtcacctgtgcctatatggagctttgatgtcaatgcccttgtcatttggtgtcaatggttttgtcattctaatttatttggccccaaggtgtgtgtgtgtgtgtgtgtgtgtgtgtgtgtgtgtgtgtgtgtgtttgaaacacagcatatgtatttttttcttactccttgagaaatagaactttaaataacatttctatctttaaaatgtacttgtgaatagttatcactttcctgaattctaccttccaaaggtaggacaagagaaggatggaattaaatcacacatgcagctatttttataacttatgagcactcaatgatggtagcatccctcttctttaccttctctctgattctgaagccactgctgttttggttcctgtatggctgggactgcctgtccactagacttcctgccttcactctgaccctgctacatttaccctgaacaccatcctcccaataatcattaccagatgctattttcacaatgttacacctttacacaagaagctacagtggaatattatccttacagaatcagataaaaatctccaggcggcattctaagctctcattggctacactgtaccctttgaacctgaacttcctgagaactacctcttagctcctgcctgtagctctggctcccatcttcatgcagtaggtattcgttttcttttgaacggcctcatatcttctctgctagcaggattggagtcatggcagaaagtgagagggggactagaaggatgcaacattaatgaaacctcacaataggttaggcattgggttaggtacttggttgatctactcacatcatctcatctaatctttgccaaaaccttaaaaggtaggtattatcggccctacttatagacatacaataggtacttaatgcacatttttgtgatgaataaatattcgggaatttttgcattgtgactggatgagaagaaactaggaaaaacaagacgtagatgagaaagatacctctcatcttacttccaacctaggagatcttaaatgaactcatcagttttaaaaggtaatcttaagaatggagtcagagggtcacacaaggagagaaagcatcacgtattaccagagttcgggattgcttaaggcggtttgacagtttcctccgggggtaatccaccctaggccaggcatttttaaagattagattttgaaatgaagctttgcacttgggaatatactgaggcaagaaagcatatcccttctccctgctgagagagcatatcccttctctctgctgttgcagtgcttaagtgtgagaattttcgaatgagatatgaaagcaaagacaacaaaccctgcaggataatagtctctgaggactttaataacagccgtttttaaagcaaagcctgtggactcctaaatccatagctgctcgtttaagatgcaacgcaatgcagtggacctgaaaacatactccttatctacctagagcaaccaggctccaagccaaacagcagtcctcaaattaactcttgtttctcttgggacgacaactctgctgcttttaaaggtgttgcgtggccacatatagaataagaagggaaaaaacagtcacaccctcttgtgagtctgtatccaactgcattttctgatctggttaggaacctccggtggttagattagaatcctgataaggccaagactgtgggtccaatttcttcctatggattcttctcgaaaaacttgttaggaaagatccacttcgggtttttttttttttttttttgcgcttgttttaattcccaatccataatagactgatacttttgtaacatgcaataaaaatgaattattttaaaaattacaaataccagacatacaaaatttaagccgatgctttttatttttagattgctgtacacgtttctaaagatttgctttcaatttctgttcttatgtcttcataatagaatatctgtttctgtgtgtgtatacgtatgagtgtatgcaagtgtgctccaaaagctctactatttagagctcatgtttaatgagtcatgttggataaccagtctaagggagttctactttcatataattgtttttgttttatttttatttaaatcattaacaccttttcaaaacaactgtatcaaataacagtcatttggtcatttgaagcatttacatacactgctttcttcttaaacagattttactgaatgtaaatctgctttccctggctaattcagcatcatcatcctgagcattaactattttgcttcgctataaaacgaggtgatgccttcaagggctactgatgcatggagagctgttagtttccacactgtgtgaccctggtcaattatgcatgcccatggctccttttacacctttctgattctctgtaaggtgtcacttcttcctactctcaatttagccacttaggataatttctttactattttgaattgtatgttcctgaccttctaagttcttagaaatcagaccactttttttcccatcaagctaatttaaattagataaaaattatcagtaaggaggaactaatggccttataattattcatatactaactgctttcagaaaagcttagagataatctgtctataataaaattcttaaggagatttggtcacttattgttattctttctacaccattgtgtttgtttccttacttctcagctatattaaaatggggaagttttcatttgctgagtcctattttagagaccaataattccatttacataggaaaggaaatatgtggatacgattattcatgatgttctagaatagtatcacaaccatctgcttaatggttaataaaatggttaataataaaaagaagggtacagcactaattcttgacatctcccttctttatttttcttctagtaaaacatccataacttttcctattcttccccagttgtattattacttatgaacaccatggatcattctactttttgaatgaaatagtacaaatttaatattcgataatcttgtctttgtacttttctttctaaacttttattctcggtggcttcctaaaggaagactttattctacttggtttaagcagttggtctgcattctacctatttctctcaactctcattgtccattccaatcaggttgtgcaattcattgtccctgctcataaaccaaattcatttcacctttactccattcccatgctattctttttacctggaatattttcttttgttccaatttcccaatcgtatacatccctcaaggctcaagccaagtcctgtaacttcatgaaatctatttctaacatctgatttccacatggattatcttgtaatagtaagccctgcatttgctattatttattaaagatctcttgtgttctagacgctattcaaagtattttacaaaaattccatgtaatattcaaaaaattcagcaggtatgtattattatttcatgtttagtgaaaccaaagtaatgaaagagttttcatcattatgtggctaataagggaaagagaagagaagggtcaaacctatgtctatttaactgcactttgccatgagttttctctggaagctgagaaaggagattcacaacaagagtagatgagactcagataagaaggaagtgtggaatttgaaaaagcccttcagaaaacaggatctcccctactcctaaaactgctatactgtgaacatattgcttgtctcataactgaacttttttggtactctcagctgaaatttgctctataattgtacagaactttaggccaaatgtttcttttatggggacacacattatttgtttcgtttgcacccattttctcaattactttgtgttttctcttgttgtattggatgcatctctatccactgctacaaatctgtttaatagtctttatattaataagaccatgaaattgctctttgtgtgctgacatagttatcctttattttctaatggcagtgctagatttgctaaaatttaggtagtagcattattaataggaaaaactaccaccaacaactaaacttgaaaggtaatatagcctagtggctaagagcacaatccctgaagtctgactgacgaggttctaaatcttgctgcatttattagctgtgtgaacctgggcatttttagttaaccttacagtagtttcattatcttatatggaaaatgaagataatagtagcccctaccctagagggttgttgagaggagaaaatgagctcatgtatatacagtgctttggacagcacctgatgtacagtaaggttcatgtatgttgttgttcttgctgctgctgctgctgctatggtttttgttatgtaacaactaccttttcccctttgttcattcgttattgcttttcctaaagactacaatcacaaaaaagaagaaaaaaattagagagcatacagtgaatgcagtaatgaaggcttgaatgatcttttctagttaagtcagaagtgaaataaaactatccaaaaatttctatgaaaattatcctttgtccagattggctacccactgagaactccacttgattctccatatcaatcttttgctcttttgtgctacctgagtctgaggtgtagtctttaaatgatgagtttattggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatgcaacttacaagggatgtgaaggacctcttcaaggagaactacaaaccactgctcaaggaaataaaagaggacacaaacaaatggaagaacattccatgctcatgggtaggaagaatcaatattgtgaaaatggccatactgcccaaggtgatttacagattcaatgccatccccatcaagctaccaatgcctttcttcacagaattggaaaaaactactttaaagttcatatggaaccaaaaaagagcccacatcgccaagtcaatcctgagccaaaagaacaaagctggaggcatcacactagctgacttcaaactatactacaaggctacagtaaccaaaacaacatggtactggtaccaaaacagagatatagatcagtggaacagaacagagccctcagaaataatgccgcatatctacaactatctgatctttaacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatgtacaagaaaaaaacaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcatttaaaagtcaggaaacaacaggtgctggagaggatgtggagaaataggaacacttctacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaaaggatgagttcacatcctttgtagggacatggatgaaattggaaatcattattctcagtaaactatcacaagaacagaacaccaaacaccgcatattctcactcataggtgggaattgaacaatgagaacacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctgcacgttgtgcacatgtaccctaaaatttaaagtataataataataataaataaataaataaataaataaaaaatgatgagtttagacaaatatcattatggtagtattatattatgttatgttatattatattatattatattatgtataatgtatattccttgcagcctgccctgcattcccaatctatgactcatgctgccttattgatactgaaaaatctccactacagcatgccagcttttgaaagagagccttgggttctttcccaatacttaccttccttttagggcaacctatctgagtcctgtagcttgaaagatttcctaccagcctgccatcccaaaggaacatggatgaactatgtttatgctgatgtgtcaagtcatttcttggtatggttcatagtagtccacatggctcttgtagacaaagagatgaattactgatggcagaatttctgttctggcaacagggaaatttgcagaaaggagaccttttcagtgtgaacattttttgctcacaggtggtccaggatgcccaatgctaaatgagaagtgaaaagagcaatcagggccaggtgtggtggctcacgcctgtaatccaagcactttgggaggccaaggtgggcggatcacgaggtcaggagatcgagaccatcctggctaacatggtgaaaccctgtttctactaaaaatacaaaaaaaattagccaggcgtggtggcgggcgcctatagtcccagctacttgggaggctgaggcaggagaatggcgtgaacctgggaggcggagcttgcagtgagccaagatcgcgccactgtgctccagcctgggtgacagagcgagactctgtctcaaaaaaaaaaaaaaaaaaagagcagtcagaattcaatttttcattcagaacaaatcaatccacgtgggtaaacattttatcaaactcaagaatgctgtctttcagggtgcttttccctcaacagtcacttatttcctcttgcaagtagtatcttcgttcaggttcagtgactactgtgtattatatccaatgcttctggcaagtgggttggtggaggcagcccaagatcttctagaatcaagagaattggatccatttcccagttctaacacttatcagctatatggcttttaggcaagtcagttaaacatccgagtctcagtgctctcatctgcaaaacagaaaatgtgatgtacttcacagagccagggggaggaataactaaggtggtacatttgtacgtgctttgtaacctgtaaagccctttactgtacacgtgtcatttacagctctgtatcaccatcatgacctagaaaagcagtactgacagaagacttatcttcttgccaatgctaagataactttagccatttctgcatttctaaaggaaggagtctttatcccagtatctatgaagacttggcaggaattgccgtcaatatttagttggtaatataaacgaattaaacaaaaatgcacactaggttttaggaaaattaaagacagaactatcatttgtactcctcttacatttcccaaagtgctaaaactagacaataaatcagtcctcaataaatgcttgtttatcaattttatattcatttatttgttgataatacaacaaagatgtttatatgcagtataatatatatggcaaagatgaaaagtagcaaattcatgaatcaacatcctatttatgcttgagaagacaaagaaagtgttggtgacttcatggtatacataaccttaaggagctcgtgattgagcctgggtctctgctatcaatgtaggatataaatttcaaatgtactatcctttatatgtatgttaatgtagtaaacatagaaaactgatgctactagtgagaatacttttacttgaacaactaaaagtttgtctttaatcccctaagtgcatacacaaaaggaaagtactgtacaaatcaagtacaacagaagaagtaaagtaaaagacaagtgaaggaattatctggaacttagatctggttggctttttctcctgaagtacttagataaattaactcacttttctcttttgctgaagaagtgcaaattaggcaggcatgttattccacgtaggcaaaaggaaaaaagaaagaaaaacataaaatggctatatatttgaccaaacttcgttctgcaagaatcccaatactaaccttctaccatataaactactttcaaaatcaggctatatccttccagtacaaacctggtttgtactactcagagatactactcagaaatactttcagtatttcccttctttcaacttctgatgtgattctatccatattcccctgcctgtctcccagtcaaagagaatgggacacaactctctttagagtccatcagtgatgctttagctgccaaaaatagtgacaatagacattcattgtctgtctaccttacttgttcaacattcagaattctgcatcttaagaggctgtggctgaaaacttgagccagttcttcagaatttctaacatgttatttctgccactttttctcccttactttagcagagtaatttaattcaatttgagagagagagagaaaaaaaaaacttttctagttacacagatcaatccaattgtttggagcttcagaatgaatttttaaacttgttgaacagaagcatacaaatctctaagagcaagtcagataatatacaaagcctccattcattgtgtaggcagaaaggaatgctggtacccggcagctctctgaggaatgttcccttggctttgactattctgctgggaacaaggaaggaaacacatatataaaatgaatttataatgtctctggcttgtaatggcagaatgataagaaaagttggctgtttaatataaactgtcagttgcatattccaggcctcctctctttgaggttcctcccacatccacacgcctggctactgtttagtgcggagtacaaagtggccgtttattattattgactggtgaggcctgtgctccaaaattcattctgtcaacagaatgtaagcaaagttggcattttaaagcagggctctttcagtttctgggttttctcaggattgctatgcaacaggatcagtgctgtagtgcccggttcaagctgaaaatgttacacaggaagacataccatgtaaaggtcagattcttctactataataattttcttgatctgtgtgtatacaagtgaagttgaatgcataacctcttatcataactcttaccaaggtcctatgtactttccacctgtcaagcctaaaaatgtgtattaaatgggaaatcaaaactaataaatgtatgatgctgtactatatgtatgatgctataataccaaggtgaacttaatttgtgttgtcaagaagattttctctcccatgacagactcccaggaatgtgctggtgctgtgggccaagtgcaatcttgtttattagtctctccacgcttttatggtcagagttaactctacagattactacgtaaatagaaaatatgacttgatccatatagtaatgaaattattggcactggggtacactttatcatagaattttattgcctatcacttccataaaataatacattttgtccatagactagaagatataacttgtgaactttataaagttataaatacattactttccaactcataatggcaaggaataaatctattacaactaataagatgcccattttaaatctacataataacaggagaaggcaatacgccaagaaaagggatttgagatgtatcttcttgttagtttagcctgattgaaatgtcttttgaactaataattatttatattttgcaattctccaaattcacattcatcgcttgtttcttttgtttggtaattctgcacatattcttcttcctgctgtcctgtaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtaggaaaagatgtggagcaaaaaggccacaaatgaattaaaatggccaaattttcctcattgtcttagcacaagtaactggtatctcacatgtctacgtaaatcatccaatttcagaatgattcactgtattttgaataaatgaatcatttatttgcttggtatggagatgatacttgaggattcagattagattaaagtggtaatgttttataaacataggagacatgcatattaagacatcagagtgaatttaaatgaggagtgcagctattctagtttcataaatttctctcttggcatatcacagggttatacaaaaagtgataaaaaattaacggatatgtattatggaattatttttggcattagtctaaatgcataccagaggacagtctttaaaaccctttataacacattacaattatataatataaaacctgtaacacattataattaacagtttagaggagatagctcctacagttaaagagagactatagcaacttcctgtcttttgcttcctctcagattttgttaaaacacatcctctgtaaactaagcttttagttgtagtatactcacatactttatattttgcccccttctatgtgccagctttctttggagaagttagttaatggatgcatcatagcatctttgtaaaaagggcagagggaagttcttgttataccagttttgcaatagttccgtggaggaacaaaaggatagagatagtaagtaaaacgcccattgtaacttaaatgatctagcaagggcggggaatgaaagccaggcttcctgctttctaagcagttgcctttcttaattcatttctctttattaaaaatattttgtgctttcttctgtgtctagagaaaaagtgataatgaagggaggtagaagatgaccaaatggacttaataatagttatgggagtatacactaaatgacgggagtagttactacctctaggtagaaagattacagaagggagattttttttcttctttatagttcttctaacttgtccaaaattttaacatatatacttctataaggaggaaaatctgcatttttagtaattcagaagcactattgtaaatgtctgcatcaagtatgaaataatgatagcaactaatatttacatgatgtacctacataccacgcaatgccataagcactttccattcattgaccggtttaatgctctcagcaaccctaagaggtagattttattattgaattctttttacatttgaagaaagtgaggcacagagaggctaaataatttccttagggtcacttagcaagtggaagatacaagatgaaaacagggagtctgggtgggccaggcgtagtggctcacgcctgtaatcccagcactttgggaggccgaggcaggtggatcacgaggtcaagagatcgagaccatcctggccaacatggtgaaatcccgtctctaccaaaaatacaaaaattagctgggcatggtggcacgcgcctgtagtcccagctactcaggaggctgaggcaggagaatcgcttgaacccgggaggtggaggttgcagtgagccgagatcgcaccacttcactccagcctaggggacagagtgagactctgtctcaaaagaaaaaagaaaaaagtaaaagaaaaagaaatcagggagtctgacttcagagtctgaacttttaaccaccatatgataccgtagcatataaagaaagaaggaaacttctacaaagaaatgcatactaattgaaaggatgaaatagagagtagattttttctaggagtagaaaaggatttgtttttatgagaagtagattgctaggagtagaacaggtttatttttatgtataaggttttgttttgttttgtttttcacaagtttgcaccctggcttcccagacattgttccttatctccctattttgtatatgaattttgtgtcaacttggtggtggtacactgggagcaacaatggcaatagcattttcaaagatagggaggctctattagctttctacagcttaaactcttaagagaggtcagtatgtgtgatgacgtaggccactttgataaccttcgtcattaaaaaagaatgaaaatgtgagatggaaaaaatattggcaggtcaagttaagttattcttttctgcacaaaagaaaaagaaagatgctataattgttccgagtatcacttagtgccttttctctgcctcatgtgaacttgataaaataaaaggagaattgaaagtggcaaatagcatgtcagccaaaatatggactcttcattctcagcagtttcccatgtcagctaccgcagtttgattcttgctgtcattaatcaggtagaaaacagttagcttatctaaggtgctgccaattctagaatttaaatattcagatcaatggttttggcttttatataggcctatgtaataatacaggatatgttataagcactcataaaaagcaaagaagtaattctccacatcaaagcaatttagcttatttcctgacacttgattgaaattagggtattgatcaatctacagcaaatggcagggttcaattgagagaagtacagtataggcagtaattagggatgattatgaaatagaatagaataacactggaagagttagatatagaaccattagtggcactgataaacctgcattatgaatcttgtcacttcttccatgggggttattttaaaatgaaaagttgccacaattaaaaaatagtttcaatgatatactggaaaaataggcctgtgtttgcccaagttataacatattataaaaaattacagttggcccattgtttggtgagcgattctgaaactgctcttatatttcaaaaaaataaaaccattaatgtgtccatttttaaagaaacaaaattgaatttaaatccaaatgatttcgaagtttccctttgtattccattggctcataagagatatccttgtgcttccaaatacaagtccatattgtatcgttttccttccatttatttttcttctgccatacatcttttctcttcctgtgattaagattcttatttaagtcatcatgttatgccatattgatacatttgcaagaatactctaccttggacgctgtttatatcatattactcttttgttcaaagcttcaatcttgtaggtctccatatctccctcattcatttatttgttcattcaacaaatatttaatgaatgcctactatgtactaggcactcttctgggcacggaggatgcaaccatgaataaaacataccaaaaaaaatcactgctctaatgaagttatatttaatcattagaatctagtagaaccttctctctctgccaactgtgcctaataagtccttgctaactccttcccttctcttttctttttctgcctccagttcctttctcaccaagcatcattctgttactccccaacatagattctctgagccaagagaatcaataaattctattttctaaccccattcctactctccaacaatttcctcactctcccatatgagtatgtacccttgctggttctcacacttgcaacattctctttcctcttattctccaaattttgattcatattccataacaaatcttttcttttctggctgtttcctcactaggtcttcccaatactattctaatttacacttgataacatgtttcttcaagtgttcaagagttgctttatagggctatgcttactgcctccagctaacttatatgaatacaaaaatttcaaactcgaaatatgtgagtatggtagagtagaaagacatgggccagcagctgggcaacccagtttcccttctgttctattctgtcactaactgtcttagcatataatcttgatcaagtcacttaactgcttcagacttcaattttctccttcactgaaatgaagagtttgaccagaaatatggacagtctcttccagttctcttgcaatcgtacaattttattcttttagttctgcaatcacactttatgaacctggaaaattgtttaatttttctaccttggttttcttaattaaaatagaactgattgatttaaaaggcattatataaagtaattaagatgtctttgagagaaaagaaatttaattgaaattgtataatcctatctcataatttaattcaagaaaagtatatgctatcattccacatgcattattacatcacatgttggccaagaggtataaggaagaaaagtaagtagtcagtgataatttaagttccatcaaacaaaacgaaaacattaactgctttaagtgggagaaaaagagaaaattatttacttaaatgtacacacacatgcatacacacacagttactgatgacgttatccaatattaagatggtaattagtcaaagaaagtgtttttcattctaaaattccatatccacaatccttgcatttttaattttagaatattaataacttgagaagtggtcaagtcaattgttttacataagaaatatatatgaagatttcaatttagtctactactagattatttttccagatcattgtatatactattaactatgaaaatcacataatatgttatcaacataatttcagcagaatttacattatgtgagatttttatatttggcagaaaaatttgtaaatgttatataaaatgttcacatttatacaattgtgaacattaagaggcaaggacactgacattatatagtctgtagaagccataaatctattggggagtgcttgctattagaggttagaatagttagtgtctttgtataatggagaacaaaagaagggcaaaaagaggtggggtctacctttgagagaaaactgcaacttggacattgaatatctctgaccttctttctctctcttttagaatgttaattatgtttggatgttggagttcaagacctgtctagaaaaaaaaaatgttgacttctctttgggattctctctatttaaagagatagctcccattttaattctgtggttctttaattttttttgtttctgaagtacaaattcaaattattcatctgttgatgacaccctggagatttttctcagtgttctcttgtagtagtttcatggtttgaggtcttacatttaagtctttaatctactttgatttgatttttgtatatggtgagagataggggtctagattcattctgcatatggatatccagtttttccgcaccatttgttgaagagactgtcttttccccactgtatgttcttggcacctttgtcaaaaatgagttaactgtaggtgtgtggattcgtttttgggttctctagtcttttccatgggtctttgtgtctgtttttatggcagtattgtggttctttattatttctgcattcctcccttttctttctgcatgtttaagtgctattttattacatgagggtactaaagatttatagggatatatcattagttttataaaggaagtcaaagtgaaaaatgaattcaatataacacatttcactttaagaatgcatgcctttcagagtaaagttttattaaggatttcaaactaggcattaaccaaatcacagttgaaatatctgtgtctagagaaataacaatcactttatcagcccctataattcttagtgtcctgacactgaggagttccttaaagaccaagcaatatactccagcacatctaaaggctctgcgttttacctaaaccttacaaattgtggaaattatcagctttttagagattagcacttgccttgttaaacggtagtaacccctaagctcttgtcttcactaataaagattaatagacatagatagaagctaagcatgcccctttgaaccacctcttttattttccgttgagtgggtaggagtaagcagaatatatttgacaattagcaatgttaaaagacaaactttagacaaattccgttttgcagagtttatttgagcaaaaaacaattcatgaatcagacagtactcagaattagaagttcagaaagctccacccagcaaggtgggcaggcagtatttatagatagaaaaaggaagtgacatacagaaacagcttgactggttacagcttagaatttgccttacttgggcatagtgtaaataggcatttgccttatatggacatgagctgatcagtttacagcctgtgattagctgaaacttgactgctgggattggctgaggctcagctatttgttacaagaatgtactcttaagttgcatattgcttacatgccaagctgggttgcagtttgctatgtacagagtcagctttaggcccaatttaatttaatttaacagcaacaagcctttttgttcagagatcaaaaacatttggttaaaaccactaaggtttaaggattttctcatctaacaaaggtttgtaatttctatttcccatatctaaataggacagctcaagttatgtttttcagcagctgttttatacctttgcaatcttgatttctacatatgcaaaacaagaaggttgaactataatctctcaggttccttccaaccccaacagcctatgtatgatataaccagaaaaaaaagtcattacaaatacaaagaaacattttcaggaggagatattccacatgcaaacataggttaatcatttcaaaatatctggtatatacactcatgaaaataaaaatagggcaactgcttccgataaatgtattagaaatgtgacttgaaaacatttcacgggcttaacatggtcaaagaaaatgttttgagctcacaatgttccttacatttagatcttcaaaatcaagtcactgacaaatgccacctttgccctgtggagaccaagaagtaatgtttggggcatatcagaaatgctttaataaatgctttatcaaagaatggttctggagcttacctgtggaattgtgaaggttcttgttgaaagcagagattgttgatagaattatagaaagtctggaggtggcacctagcaatctcaattttaaacaagctactcaaatgtttcttatacacactatagtttgagacccagagctttaggttgaatacatttgtatatgctgttttaattcattctctggctgcctttcacctcttcagttcttactcagtgttctctgtcctttgtaagtttttcgcttcagtttttgtcctcctatcacatttttcctttcactcttgagctttaggagaggaaaaaaatgaagcaatttgatatgtagttaggatgatcaaacattctgaaattttatctaactccacagcttagaaaaaaattaaaggaagtccccttacccagatatgtgagagcttttcgtcttttgaggttccaggtccgtcttctgctgctgtattagctctcttgactgtcctctgtccctggcttctaacaacttccctatttcatgctattaagtttctcttagatcctttagaactgaattcccggctgggtgtggtagcttacgcctctactcccaacactttgggaggctgaggcaggtggatcacctgaggtcaagagttcaagaccagcctggccagcatggcgaaaccccatctctactaaaaataccaaaaattagctgggtgtggtggtgggcgcctgtaatcccagccacttgggaggctgatgcaggagaattgcttgaacccgggaggtggaggtgcagtgagccaagatcgtgccattgcactccagcctgggtgatagatcaagactctgtctcaccaaaaaaaaaaaaaaaaaagaactgaattccctaggtctcagttattttgctctctcttaggggacctaaaggggttcattgacccactaataatgagtcagcaccatttaacctagaactggaattttagcacttccttacataaacaaagccgcagcttgaggtcttaacataggcagcctgcccttcactatatcctcctctagacctctctgccacaaggatattttgtttcctctaccaggcagacagaggccaaacattagtcatcgttatattctctcttcccttcctctctccctactccccaatgtatcctagagacttaggggcagtcaataaatatttatttaatcagtgtcttttctaccatttgctgcttttccatgtctgagccctacctctctccacctacttttcaatatgtcctgcttgacagcctcttttcactctcaaagggaccaagctgtgaattccagacaccccaaggaattcgtttaaccattacacattacatgctattaaacagctaaaatcttgcatggggaattgtcgcttaggcttatcatggaaaagtggtaactgaaaggatggtacagaaacataaaagaactgacctctaattgtatgcaatctgcatgcactattatattcaattcatgacatttatggtatttcacgattcagttcttgggaaataatacccttagagtctggaacaatttaatttatcttatttgatggaaatgccttcatttttcctggacatattgtttatactgcaattatagaaagaaaatcttgacaatttggaaaagtagaaagattaagaaataaatcacctgtaaatctacctctgagggataacctggttgtcattacaaaattttttcctagtcaagcatgtgcatacaaatacatacacatacacaaatgttttagaaaaattcaaaaaatgtatttgttttgtaacctgttttctcatttagtaactgggatgatgaccttttccatatccataaatatttggctatgtcatcatattgaaccttgcaaaggattttactgtatgaatgcaccattatatatgtaataattcccttttaaattaagagctatttaattaaattcatatataaatttcattaatttctaaatttaaagcatatacaagtttcattacatttgaaaacaatcagtaggttggggttttgcatttctcaagcaattccctcatattgaatatttaagttgtttctgttttgttttatcaatcataaatgatgctatatataacatttttccacctatatctttgtatctttttccaatttctttgttagtataatttccttgaatttaagcctgtgggtcattgtctttgcacattttaaagacttttatgtattgtcaaattatccttcagaaagtttggaacaatttaatttcagtagataagtattctttggtgattctgtttgactaaggccaaaaggagaattgtatttgtaatgtcaagctaagttaccaaatggctaagggaaatgttgctccacctggttgctttgctttacatttcaatctttgcagcgttaaagtctttattatatttatgttataggtagcgttattatgaattaattagtaattgctgataatagctgagtgattgagcataatttctaatttacctgaagataaagctttgctaacactgcgtttcctctttgttttctggatgatgatttattttattaatttagcttctcatcttcaagtgaaatgtggattttatagcacagatcattcatttgtgtattcttaaatggcttctaaggattaacgtgttctaaatacagttgacggtaaagcactcagtctcctgcctaaattattcatgttcgggggaagctttcagataaatgtctgattttactcttccatgtgagttgttgtcttagtactttttacacaaaggaaacaaagcagaaaatgttgaaacttggtgaagacaaatcccaggtgcacacaaataaagaagggtagggggaaaggagacgcatttgggaagaggagcagaaaggaacagacgccagatggaagaactcaatggaaaaggctgcctagggtgtagaaatggaaaagtcaaaatgtggggagagacctttccatttctcaaggcaaaaagaattccagtactagcatgagtcacatgaaaacgaagtgtttttcattagtcactgcatccaattttttctaccagaaatattaagaattgttgactacaacagtatggaaaagcaatagattccagtgtgtatttcatgccaaaagtctcagcattctgcatgtggaaataaacatatggctaaacactgccttttctcaaaattgccatcaaactatcctctgttttgtggctctcaaaagtaagtagccagatttttattcaagactgctttgtagttcacaataggtttattgtactttttcaatggaattgttagaatcatcaattacacttctagatattctgacatggtacgctgctgttctttttcaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggtaggacatttttaagcctcgtgccttgcacatgttaagcacatagtaatccagtgactattttaaaattaattttgtttgaaattaagttgaatagaaatcttttttactcttctcacccaagggtcaattataaataatctaagccattacactgtaaatgtcaaacacatttgtgttaataataccctttaagaaatcgtccatctcttttggctatataaaaaaaagcttttcatgatgaaaaatattgaacatatacaaaagtagacagaatgctataataaaactcgtactcatcaagacatcaacaattatcaaatcacgtcagatcttatttattctatagctcttcccagattgttttaaaacaaatatcaggcgtgtgttattttattgttaatatttcaaaaggttaaaagataggattcactcttttaaggtaatcaccttgctactataatgcttttgaaatatcaataatttcatcatatcaaatatccagtccatattcaaatttccatttttctcatacatattatgcattttttaaactttttctggttttggtttaaataaaaattgaaatcagacccacaccttactttggttagttggtctttttattactttttgtttggaagtaattacagattcacagtaagtttctaaaatagaatagtttccctgtatctttcaccctgtttcttttcatcattatatgtcatgcaactgtagtacaattcttattgtcatttcaacatgcaatcaatagaaaaaatgtacatttacagcacatctcaattcaggctcattacattccaagtactcagtagccagatgttgccagtagctaccgattgaacagtgcagttctatagtttgattgtatttgggtttggctttttttggcaagactgcttcacaggtgttcgtgtattcttccatcatcaggaggtggtatataatgccttgttttctctttttgtgtgatgtttaatagctgttcacgatcagtggctaggggttgcagtgtgataattgcctatctctaccattccttcttcatttattcactggggtaggtctatgaaaaaaatgttttgcacttgtctcctattttggtactcagtatacctttcataccgaacaagcaaaatacgtttcaattttaccaatttttataataacaacttgttcactagcatcctccaacgatgaccaattatttctttgtttgtttgttttatttttatttacatttctatcttctctactaagctctgagtgaaaaaggcagagattttgtcttgttcacctccaagaccctagagtctagtaaagtgtctggtgtagagtggatactgataagtgttttggaaatgagaataaaagatacaagaacagaaatgaatagcaaaccaaacaaattactaccaaataataaaaacttgataaaatggtaccacttttgtatgttgagcatgtaaaggaaagatctctgtggagatacagccaaaggtggcatcttgaggaaaggtcaagggtttatattattctggagaagaggatataggaaattataaaaagggaagagaacatgaaagaagacccagggatctttgcaaaaaaaaaaaaaaatgccagggaaactgccagtttctcctttagccatttgccttcatatatttctgaatattaaattagcttttgtggtagggtgaaatgtaatggtgctatgtgttttaaatgttctgactttgaataaacagccaaaacactctggtgtacatatagaaaagcactcattgagaaggatgggccttttttaaaaaatgcattatgcgatatagtgaaatgagacagaatttctacaaaagatgaattttatgctagttccagaaaccaaagaaaatgaatcactggacatgtgcactaggagtcaggagactgagattctagtcatatttcttcataagatggattctgattgctattttgttcttcaactgtaatatgaggaaattggtccaaataattgctgtggtttcttccagccagtattttgttataaatactgcttcactattcctggttattagttttggttgcttgttaagagtggtaaaatgtctgtacttaacgcagtccttactcaggaatctcatgacaaagaacatgacttggggagatggtgatgctagagttatgagtgatactcaccagaatgaagttaatccgtccccacttggttagtgtgcttgctcagatagctacctgttaacctttcgtgaatttcacaggacttccagcccattgattactctgtgttttatacattagttcctctgcccttccatatttacctccttccaaatacaacttagattcaatcatctaaattttaataacttgttttcaaaagtctgaaaccctttgcttctttatctttttgttgctgcaatctacaaaactccaaaactctagctaaatattccgagactctaactaaatattttctcataccagacaacaatgtagttgtctggtacagtaccttttccggatgaccagccttcagccttccactaccaagacatcactgggtcaatttttttttttttttttttttgagactgggtcttgctctgtcaccaggctggagttgcaatggcacaatcttggctcactgcaacctccgcctcctggttcaagcaattctcccgcctcagcctcccgagtagctgggactacaggcacgcgccaccatgcccacctaatgtttgtatttttagtagagacagggtttcaccgtgttggccagatggtctcgatctcttgacctcgtgatctgcctgtcttggcctcccaaagtgctgggattacaggcgtgagccaccgcacctggccaatttaccttcaaaattgtttttgactgtctactattgttatcatcataattatagaagaccatttctcctaacctttctgcatctactcttgccaccctacaatgcaatctctacatttcagtcagaataatctgtgtaaaaaacataaatccaattatatcagtccttatcttaacactatagtagtcttctcagtgctcttggaaaaagaccaaaatcctcaacaagggtgacaaggcactatctggcttgtctggcctcagcctcctctttcctagatgctcttcccttgctgtttggatgccagccatactgcctccatttactttttccaattctgcgtgtccctcttatgtggggctttaaatatgttggtcctctgtctcaaacccttttacctatacccacccactcataatatcctggttatcatctaataatcctttacatcttggctcggacattgtgcaaacttttccctgttgtctacatttgaccagatctttctttacacacttctaaaattgtctacttttctataacatagcgttgtttgtcatcacgtacatgtgttactatttgataaatatcgactactcttgctaaaccatgtccttcaagaagatttttgggagggggaaagctgtcatttttctactcagcacattccaaagtgcctagtatacagtagacactggttagataaaggaaggctattgagaccaagagcagggaaagaaagaatagagtggtattcccttcttatttacaggagttttctgtttatttctaattaagcatctttttgtaaagtgtgtagagctactttgatgcacaggtttttttttattattatactttacattctgggatacatgtgcagaaagtgcaggtttgttacataggtatacatgtgccatggtggtttgccacacccatcaacccgtcatctacattaggtatttctcctaatgctatccctcccctagccccccaccccctgacaggccccagtgtgtgatgttcccctccctgtgtccatatgttttcattgtttatctcccacttatgagtgagaccatgcagtgtttggttttcggttcctctgttagtttgctgagaatgatggtttccagcttcatccatgtccctgcaaaggacatgatctcatccttttttatggcttcacagtattccatggtgtacatgtgccacattttcttaatccagtatatcattgatgggcatttgggttggttccacgcctttgctattgtgaatggtgcttcaataaacatacgacatacagcttttacttgtagtttggcgcaatgctttttcaagcttctcttggtatctttaagaaaaattcttgacacaaaacactctccttcctcaaacaacatcatcgctcctgagtgctgatgagagaacagtttagtagcctgtttgactcaaagttttgtcacatgtatgtggtagccctttcatatatggactgtctagttagtgatgctcttgaagcctatgggcaaaagaacaatggaaaatccttgaaactggatctgcgtatcagatctcctgaactcagttagaaaaagagaaaaagaacagaatcagtacaaaattccatcaagatctaatagttgacagatcttatatttgtggacttttgttttactttgccatgtttccagaattgtacattgtattgctctttatgggtttcttgatttaattgttgtttgtatagaatccttggtatcaagatgggtcactgtaattgtaaacttattccgcaagtatttagagtgccacttttttaaaaagtcatctgcttactctctattctaaattattaatatcctttgctgatgctttttatggggatacaaatcccattaaaatgtcaatagttgaaactaaaatcaaatgttgttcattttcactttcattttctataaatcaggatgtttacaaaacaggtaatttgtgtttttctttgtataccatttcagattagtgataatattttgtagcaaaatattacatatcttgtactcttttcttgtagagaaaatatacagtcaatatcaattgctgtcatggagagatatatggttcttctgtaggtaaaattccaagatactccacagacatatttggggaccatagtctcactcctcaaagcaattttcacacccatgggagtagatctgtgctccccaaaccagctgggcagcataacaactgcaactgaatggctctcaagactaattaataaaataatgctccagatgcggtgaagtgttataaataattaaagctcaaatatgccttagcaaatataaactgaccaatttttatgtcttttgaatacattatcctggcttttacagttcctcattacttgcctcactagactgactcgttttcaattagtgggtgttattctggtccagatatattttaaaaactgacttcctttgttttacttgagcagtcactaaagtgatatttattacttgtctacttctgtgattaacctagagagagttttaaaggagcaaatcatagtggggaatttctaaggagaactgcaataaaacatcagcttattcaactcccttcctcctaccccaaatccaaatggagattagatcttgattgtaacaacagtgtaggtaatgactttttgtttgcctttttactaatgaaattgtttgtcactaggttttcatctttcaattaaaaaaatctctataatcccttccctagagatcattaaggataccttcaaagcttcccgagattttctggttaagatttagatggaagtaatcaatacatacattattaaaagagtggacagaaagccattattgcttggatgctgttgacaaatgaaaaggcttgaataaagtagtttacttgttcatttgtcaggtcatatattatgcatgttcgatttcttcagaagtcaccacaaagtgagagacaggctgagaaattcaataaaattatcctgaaatcatgttgtagattatacatttatttaggctcattctgttatcagtgctggcctgcttacgtgggatacattttagtatgtatgttagcttgacgagttttctgtgttttctttttacagaaagagaaaatatctttggatgtcatttgtgaatgttaagatttaagtcagctctgtgttaagaaaaatgcgttgttccctatcacctctgaaaaacaaccaaaagttgcgatagagtgattcattcttttttcttttctttttatttattttttctttaatttttttttgagatggagtctcgcctgcagcccaggctggagtgcagcggtgcgatctcggctcaccgcaagctccacctcctgggttcacgccattctccttctcctgcctcagctgggactacaggcacccaccaccacacctggctaatgttttgtatttttagtagagacggggtttcaccgtgttagccaggatggtctcgatctcctgacctcgtgatccacccgcctcagcctcccaaagtgctgggattacaggcgtgagccaccgcgcccggccagagtgattcattctaacattcaatgacctggcctcttagagtttctaaaccacttgactgttagttatatctactctaaggtgtctttttagccgcgttggaggaaatagacgtctttttgatctattcttcatcatttttgtataagtttgatatcctatgcagtcatatttagggatgctgaatagaaatgacttaaaaattatttttagaactgcatttctaggcatttgagtcttctgaaaactaagtctaagtcttctgaaaactagctttatcatcaaaactgaagaactgagtcatctaggaattgctgctttgctttaatgactgtaacaagatgagatgtgaataatttacaaactgacttctctaccagtcttctctctcactttgtcaaaatattttgatgtcctgacaaatactctttaaaacagtatctgcatagtgttttgccttgacaaagcacttttacacacattattcatttaattacaaatgatccccttgatttttttctgtgctcttccttttgtcccccaaaaacattattttaggaaaaattataccataactcagattcctagaatttattggttctttcaagaactttttttatgaagagcctactctatgttaagcatatgttagggaacaaaatgagtctctgcccctatggatgtttagattttagtgacagaaatacatagtaaacccataaattaatatatgaaattatgttgggtagtaagtgctatgaagagaaaataaacaaagcatgaatagagaaagattgaggagtactggcctatgtgaggaggttattttggggtaaagacttgtgtgaggccgggtgcagtggctcatgcctgtaatcccagcactttgggtggctgaaacaggcagatccctggacgtcaagagttcgaaaccagcctggccaacatagtgaaactacgtttctaccaaaaactagctgggcgtggtgacacgtgcctgtagtcccagctacccaggaggctgaggtaccagaatcgcttgaacttgggaggcggaggttgaagtgaaccaagattgtgccactgcactctagcctgggtggcagagtgagaccctgtctcaaaaaaacaaacaaacaaaacctgtgtgagtgagtaaaccatgcaaaaaccttgaatgaagaggattctaggcagaagaagcaccaaattcaaaagcccaatggtaagaacaggttttgagtgttgtagaaatagcaagatgagctgtgtatctcaagggaaataagatcagtagacagtgataggttctagaaagagggaaaggccagataatgaatggtcttgcaggccatagtttggaggtggattttattctgtgagtaaagagacatcactggaagtaaggaaacatcactggaaggctctcagcagggatgatgtgatctgatttatgtgtttagaagttgactcttgctgctatggagaattgactataaaaagagcgaaactgaagacacagaaaaggagggtggtggagtcatctcagaaggaaatgattacttggactagagtggaaatgataggtatggtgaataattatttgatcgaagatatatttggagggtagaattgatagaacttaagatagatagaatgtggagtttgagaggaagcaaagagtcaaggaaaattctgaggtcaatggcttgaacaaataaaataatgatgttgccatctgagaaagacttgggaatgatcacgtttgagtgtatgtgcttagaatgaaccagggttccatttttggattatgttgatagacagacacaaagggtatgattcagatattatttaccacttatacttgacaatctcaaattttggctcagtatcttgagaacatacacaaattaatttgtcacagggttttctaataatccattcatttctactaacatttcagaagtaatttccaaatcttaaagtttaggcttaatgacctaagacctaattccctaaatggccacgggaactagattgagttttcaccagtgatctctcaaggtcagctcagaacttaacaacattattgtcagtaggaagtaacttccccagtgattgttggaagcagcccagccttagaattaagagtcaaacagctgttcaagatgctgtgtgcgcagtaaactattcctccatagtatcacagacctgcaagcaggctggactattctagcccgtgcccttgatctcagagaatacaatctttgttttcaaagacttccagaaaaataaatctcaacacagagtttgttaaacacattttccccttatacactcaaaaatgttttttcattgactataattagatttttaaaaaaaaaacataatttcaggcctgaaatatgttcatttacttttcaattttacatcaaatttattcaatctcatttataaattaatattgttgttcatgttgttgactatctgaaacaatgaatggatgtatctgatacttcaatcccttatcttcacttttattcagaagtggagtgaaaataaggcggagctttttgtcatcttatttagatgattatttagtcaaactcatagaagcagagagtagaaaaatggttgccatacattgtaagggcgagttgttgctcaatggatataaagtttcagttatgcaagatgaaaaagttctagaggtctgctgcataacattgtgcctatagttaacaataccgatttgtgcacttaaaaatgtgttaaccgaggtccggagatcaagaccatcctggctaacacggtgaaaccccatctctactaaaaatacaaaaaaagaaaaaattagccgggcatggtagcaggcacctgtagtcccagctactcgggaggctgaggcaggagaatggcgtgaacctgggagacggagcttgcagtgagccgagatcgcgcaccactgcactccagcctgagtgacagagcgagactccgtctcaaaaaaaaaaaaaaatgtgttaacagggtaaagttcatattaagtgttcttatctcaataagaaaagatgattatggccttttctttatagcccagatacccatgttcataacttctgtaatactagctgtctcaaatgactattaagggaaacctctctttctgttgtttgctccattgcctctttcttcaaatttttttcttccatgaacccctatgaatttgctttagattactgggggcaatattcttgccaccctgccatgtacatcctggattgcttgcccttttccaagacctcgcttttaagttaactgagcattgcttgtcccgaagtgagcatttggtaaaatattcttatgtgtttgagactcaataaatatggtggctctttaaataaagaaggtccttttggtgacagaatatattcagcaactttcttgtcagacatagaaacaatacaggagacataaaaaataaggtagaaataacacaggaacaagaatgatgacgtaggatggcaaaactagtaaatacagatcaagttacagatatgactgttaacatcttgttctatgcctgctcggtatccatttgttgaatgaacagaactgttggatcatcctacatttcagagcctgtctagtgtcctctcatctcctacctaatcctgcagactacagaaaaagccccaagcagcagttcaaaccatggaacttctgagtgtttggacatgaaaatctcctttaagaaatcactaggttgaagaaggcaatgctaatgggaccacttcttgaggaaattccacccagtaactcagcagtgacactcagctttggatctggaacatgagtagacctagaataagatctgtccatttttcccaatttacagcattaattttttcacttatgattcatgagtccaggctttcccctgcaagcctgttttgcatctaaatcaacttggccttcatataacacactctagtgttctaactgggtgttctgtatcttagtcaacaatgtttactgagcatttactatatgccaagctatggctatggtttttaagcatcgataataacgatgcttagcagagactctcaaactgccaccatagagcaggcctgtggccgattaatgatcttaacaaattgattatagtatatgagaactggatgttagaacttagataaggttttagcaaatgcccacattttacaaatgaggacacagaggagcaggaagagtttatcaccttttctggatcactgcagccaggttctggcccagcccaggcttgaagcccaaggcttctgccactcagaacagtgctcttttcaccacttcagcctgcctcccaggatgattctaggaagttctgcttacaaatatgggtagtatttctagtcattccatcagattttattctgaaaaacacaaatttaccatttcaatatgaatacaggtaaaattcagcgccaggcaagctgtacatgattgaaagacatctgtgttttgaaaagcacgggcttttactcacatccatagtaatatgatcctaaatccactgtccccaggagaaagcaagatagcttttctccctgtcatgtcattacctatgcccagagttctcctcttgttcctctcatgaagcaaatcaatatctcacctttcatcccctccatacgtggttctgagctacttctatttatggcattatttagatatttttataatataagcaggaagcaagagggacagaaaaaaataatcagtggccaggtgtggtggctcacacttgtaatcccagcactttgcgaggccgaggcaaacggatcacctgaggtcaggagtttgagaccagcttgcccaacatagtgaaaccccgtctctactaaaaatacaaaaaattagcagggtgtggtggcgcgtgcctgtagtcccatctactcaggaggctgaggcaggagaatcacttgaacccaggaggcagaggttgcagtaagccgagatcgtgccactgcactccagactgggtgacagagcgagactccgtctcaaaaataaataaataaataaataaaaataataataatcaataacttggttcttctctattactttcaggaattttttaagtttctgatttcttccatggccattaggattttccacttatgtggcttccaaattattctaagtcagggagattttatgttttgttatcactcactttcagcttcactttagaattgcaagatttagattcaaagtgtgtaattaactgatggccttaggtaaaccctaacttatctgtatctcaatttgcatggatgaaacattcataatataaaagtatacaccacaaatatacctactcaaccaaactattggctccttaatgacaaagattaagtctctatatctttcctaactttgtacctaataggttcaaaataaatattttttgaatgaacaaattagtgagtcaacaatcagtcacccggttggccagtacctatggtgttttaagtgcaatctaccagataattcaaccttcataataaatagatttatcttgagattatcattgctataatagtgtagtagcatacttcatataagtttattttgtgaaccttaagaagctcaaggacaaacatctgtgtagtattcctaacattttctaaattgcatattttattttcatagaggtgctctacgtctttagtattgcttctaattctctcatatcactattttggacccttgggtctggctgtcttggaaaggtgaaaagaaaggtatggggaagaggatgtgttttaacaaagataattttatctgttcaagggattcaggaagtaattatcttaacatctgaatgctaacatctgaatattgtaaatacgtattctgtatgtacatgggagaaaatatctatatctgataccttttctatcatcacataaaggaactgacttctctggtttaaaatattaaccaaaatttatatgacaaaatcagtatatatgagtatatattttctcaaacctctttcaaacaggcctttttgggagacaagacacttatcaaaatcaaggctcttgacattaaatattcttgtttgtctttttttaaaaaaaagtcttcatttttctttcttttaaaatgcaataaattatactacaacatgcagtttatggtgagttattagatactgaaaaattggctttccattattttaatgcagattctacattgctttttttttactacataaagccatttgttttaagctccatgctacaaagaccacagatgttcattgcctagaacagtgtctgatacatagtagttgcttgaagtttgttaagtgactaaattaaagaggatcttacatataaccatgtttaaaattacatattgttatttatagtttttcccacatgataagaattattgccattttctttaacctctgacctccttgaaccaactatttctctctttttgtgggagttttatccttttgtatttaatctgaatcttttgaaattctaaagatacaatcacttaaccctctcttccatccactttcttttcttaatttcaggcaacaatgtgaaaataatggtgcttatgtctttgtaataacagaactttctttgtcttttctttggcctcattttaatcttcaatgactcatatttaagaaatgaactgtgcagctgtggtggatctaagtccttggcaacaactcgatgggcaaacacgtggtctctcacaatggatgctccttagctttgaattatttactgtccagttttaacaatggaattatatcatcaaatagtgccttggactttttaagtttttagtgccttaagtttttaagtttgatgagacctttaagatccatttccggccgggcgtggtggctcacgcctgtaatcccagcactttgggaggccaaggcgggcagatcacgaggttgggagatggagaccatcctggctaacacggtgaaaccccgtctctactaaaaatacaaaaaattagctgggcgtggtggcgggcgcctgtagtcccagctactcgggaggctgaggcaggagaatggcatgaacctgggaggtggagcttgcagtgagccgagattgcgccactgcactccagcctgggcgacagagcgagactccatctcaaaaaaaaaaaaaaaaaaaaaaaagatccatttccttattttacagaccttgttccaacaattatctccaccttctgtcaaggtcgtaacatatatctagggtgaccaactttcctcgttttcctgagactgtccaattttcctgaaactattctggttttaacatcgaaagtctctcatcctgaaaaactcaatgctggacaaaccaagatggttggttaccctactgctagcttccgtctttcactctaggttcaaatcattcctatgctaaaaagaacttcttatccctttgtcttgttatcctctctgtcctcctgtcgtgtcttcctcttttccttctcagaaaaagaaaattgaacatttgattttcacttgaaatacctactccttcttccactcactcctcagctatgcctacttctgaggcttctgccctccactgaaattgctctcagcacatctagtgaacactctgcaatgctgatcttactttacttctgtgtttcattggactcacttggtcaccctcttcctctcaaaattctcactctctccttgaaatttctacactcctcatttcccctaatctctccacctatttgttccttttctatctctcaagagatcctgttcctctgtttgcccattaaactttgatatgtaggcactcaacgtatattagctgaatgagaaaataactcctaagtattttttttctcctcaaacctcagaatttattatttccttgtggaaggaatgttagctttccaagctgagcatatcacagtcccttactctgtcccccatgcacagaacaccccccccacacacacacacacacaccatcatgttgcatttttaatattactcttcaataattttatcctgaatgagcatgaggggttctgaatcagaggcagatttcatttaattaccttacagtaaatattgttgctgtgcccttcctttgcccaaagacttacccctagggcaacatgatgaacgctgatgaaacattttcctacttgagtggctgggtactccataagtgggagactaggaaaaatcattttttctgcttataaaggagaaggaggctgctatccatctctcattctgaaaggttctctgtggaaacataacaggcctgagtcctaattccagcttctgcagaaaccagctagccctgtgtgtctcatgttttacaatctggaaatgtctccaaggtatgggcttcatattttttgaaatgtaaatacctagaaagatacccactccagtctttctaacaacatagagttcagcttaggaacctaccctgagctataaccgtttgaccctcttggatcagagaaatgaactagacaaattgctacagatctaatctccatggtgtgggaagtttctcaggaggctagagctttctgtaggtgaactgagacatccaggaaagtttatttcctcatacttagttgaattgcacccagcgtttgctcatctactcaacctagacactaagtgtcattcttgtttctttttctctcttctctccagcatctattcagtcaccaaattttcacacttcagatttttagacatttccctatcctatccctgtcatttttcctggtaccattgccctgagtcaaatcctcataatcttgcactgaattcttacaattgcctcattatctctctgattccatttctgttcttctcaaatacatactctgtatttatatcaggaagatctatttgaagcacacatattcctgtgccactcccttggttaaaaccgttcaaaggttcctgattaccttcaaggcaacacctaagcctcttagtggaccatatgtgatcatagagaggcagagcttcaaattctggtttaaaaatctaatgtatttccagatagcaatagtgtctttttcatctttggacatgccctctccttgttctttatgctctagaaacactggcctgcttgagattccgatacataccatactgcactatgtcctatgactctgcacttgcattttcctcttcttggaatgttctctagcatactcttccttgaataagtcatgttcatgcttttgaattctatgtgattactagcttctcctggaagcttttcccgattttcttccccatattgcgcaagtctatagcactgtctacattgtattgaaattatttacgtgtctgactcttctattatatgttaaatattcctaaatagaaagggctgttttgcattcaactttgtatttccagtttcaggtacaaccactgacacatggtagttcaatagagggagccattattatttttataattagtaatgtcagtattaattgcctcccttcaggtccaaacagagaaactaggcaaaatgataatttacttgaatttgggaaacttaattgtatgaaaaaaaacacaagaatacaacaactgaacacacacacacacacacacacacacacacacacacacacacaaacatggagatttcaagtgaaatatcaggagaatcagctttatatgtaagcagagtaaataactcacgtatctagcatgattttagggtacagaaatatcccattattcagaaagtacttccctatctgtaggctgaatcctaatattctacttacagaactccagtattttggttcaaacgccttccctttctctattgaattgtaaatagctgtggatgatgaatcattttgcaaagtatcagactcaggattcttttgaatggtgaacaccgctaagattttattaataaatgtgtcatacaatacagctctggaacacttctgtaacataatggcatatctgaaattcaaggaagaatactgctaatttgtttttccccagtgaaagaacagggcttaaattcagcaggcaacattgctaaaagacagagttgaaaaaagttacaaaaattaagccctagatcagggcaaatattactgttattgttaaacagttatattagcatttatgtagcatgcacttaatacttttattaataccctcacttctgagatcaaagaatctgggtcaataactctcttcaatggtgtcagagtatccgttaggttattctaggctcacggtatacctcacgatccttttagcactcgattatgtgtgaacttactgttttcactctgcttctagtgttaattttctcccttctttggatctagaaactttttgaaggcagaaactattcattttgtttttctcttgatcccctggataaaggaagattacagattaaagattaattctagatctgttcatttatagaaactagtgtccgcaattcctacatccataatagctcaaaacatttctactattctcaaagaggtcacaatggatgatgtaatgactatttttcaaaagtattgagacttttctcttagcttacctattttataccttgtcagacattttgacagaattaactggtgattgtcagttggattcattgtatactttaatatagcctaaggtcctgcaaatggcccttaaggcttcccattatgttctggatatccactatttggggtatgtttaagtcctcattagccatgctagagttttgcaatatataccttgaaactttagctgtagatttgaagtatggctgtcaggttacataaacaaagcactcttatctcaatgagagggcattaactatccagaatgctccccccatctccccagaatagctttacaaacacagcgctttcctcattaacagatagacccatatagcctttaaaaaaaatcattttataaccatcagtgtataaataaaagagatagaaattgacctgggagtttcataaacaagttctgagcacccaggattaattttgagaagaatgccacaagccaaataagcacttcttttcatctcatttcacaggccttcaagagggaattgaaaactaaagaacctgtaatcatgagtactcttgagactgtacgaatatttctgacagagcagcctttggaaggactagagaaactctaccaggagcccagaggtaattgaatgtggaactataataacatattgatagaaggatcagtggtgacggagcagcccatccattcttgctgccagggtctggatagctctcatattttcttggttaaatagaatcaattcaaattaaacatagatgctgaaaaaaaaataaggactcataaactaccatgcataaatcagtttgtgcattcataaataaacatcaaaagagattagcaatcagttattggaacatttagaaaataataaacaaagggagttatctgtgaggaggaattctattgttgcaaagactacaagttaattttccatttaagagcctgcctgaagtaaattagagcttgtggtatgcatcctaacgtttttctcctcaatagcttaagtgaatcttaaattgtcggattgatataaggtagaaactcaggaagatatactttagatgttctgggctgtatcaaaatttatgccaaagtataaaaaagccgttaatcagtaggttaccctcttgttcaactgtactctttctttcttccagtatgacctttttgacaatgtttaaaaaaaaagaatgtggcctaaaaccttgtcatattgccaatttagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggtaccgtctacttctttgcttcagggccctttgagagactcaaaagagcttctaatctgaacttgagtgcagtgttatcttcccacaaagttaaagctagagaaatcagtccgtctttcacaaattcagtcttcattcacatggtattttctccaagagaagacagtgatctaattatttgtctgtcttcagttatatgaaatgaaatattaaaacagttacagggcaagaaatcactttgactttgatattaagtgattgtactaaagtctgatgtgtgtgtgtgtgtgtgtgtgtgtgtgtgtgtgtattggtgtattgcttgtgttacttagtatcagaatacagaaaaataaaacacttaatcaaaagccaggagtctaggtgttggcccttttgctaaccaaattacatgacttgggtaagttatggtttggtgaaataaggctgttaatgtgttgcccttcccttggaaggcaacatttgtaatacagtttcaagtttcattggcccactgcagaaatgagggaaaatcattatatatttggaagaccactgtctataagaccaaagttaaattcccttgtggcacaaagatggcaaatatattctgtagaaaaaaatacatatttaggagtatcattttgaaatcagcaactactcatctattgtcaaaatcacaaaaatcctcctagattaaaattcaaaagaagttaaattccctcatgcactcagcatgtttgccagcatctcagcatcctcattctagaagttgtcctcttccttggctttcatggaactgttccatccatgttcttcttcctatatttttctagattcttctcctagccacccctcaaatactgttgtgcccaagtttctaaccttagcctaattctcttttgattgtttaaaccctccctgtttgagatggcctggatggtgatgtatctacatctctagtccgcatctctcttctgatctctgaatccatgtggcattacgatcacaaatgcaactattctgaaaccaagttcatttgttctcctgttttccatttccctacttctgtcccctcttatctgaccttttttttcctgtttcctatttcagttaatgaatcatcatccaacaaattttccaggctagaaactttaggttcatccttaaacccttctgcattttcactgatggcacatgatggctcatgttacctcagaatagctcttttgtgttttctctcctcttttaaccaatgtcctttttaatccccagcatcttttacttagatgataacagtatacatctttaaatcccattcacccctctgtgtgcctggcatatctcagatactgcattttaaacatttggtgaattaatggatggatgaatggtttctttgctgatgttcctgcattacccagcttcttccaattccaatccaaactccttgcgggagaatacttgcctagagaatgaaatccaatgaataaggagattacgtggcccttttcttcctagccttgacttaccttctcagccatagctcctattctccagaccatttaatacactctgcccatatgatatatatatatatgtgatggcatatttgggaaaaaggggtgatatgggcagagtgtattgaatgtgtgtgtctgtaaagtatgtgtgtgtgtgtgtgtatatatatatatatatatatatacacacacacacatacatagttagatatatacatagtatatatacatatatacatagatatacacatatatatacacatagatatagatatagatatatctgcctttgcaaatgctgttctctctgtctggatccccctacgttgtctacttggcgaattctccttcagccctcaaggaccagccaaaatgttacctatctttgttgtctttcctgagtgtctacaacccccaactcccaccaagcagaagaaactgcttacagttggtactctcatagatcaccaagcatgctaaattgtcacacttaaatttcacatatattgtagcaacttgcttatgcatttttttttctcccagagaaagtgaagttgctaagagcaaggatcatgctgtacatctttgggctgctagcccagggccagcaacatatgaggaatctcattaggtaccttcatttattcactcaacaactgtttatgagtcattatataatgtgctggacaggtagttataaaagaaacagacttgatcattgccttcatgaagcctatggtctaatgttgaattgcatagctcttcattaaaatagtaggtaaaatttttaaaaagaaaagattaaaaatttgactctaatacttgtaaaatcccttctaccccaatgttttatgaccccatgtctaacatttaaagtaagggttaaccttgctgtgtactggaaaactaagggttttgaaatgtattacctagtattttaaaagcattaaatatgttgattttattcaaaaatatagggactaattttttgacagacttctccaaaaatgagaaataagttaggaaaatgtcccagtggaactaaattagttaatatgtcaattaaattgctcaatagataggctgtagagcagacataagggattcatttttagccatacttgtcacacaggtgcatttgtaagatactgagtatggatggagaagagaatgtgtacagcataatttaataattaaaaataactaaaagcataacagttcaagtatcagctggccttcacccaaccctatttgcggtattccttttagtttccctgtcttatctgttcttggtcttaagacaaacttcattttccataccctgattggtaaaactctcattctgatcccaatgatagcaaaacatataaacattaaacatacctttcgaaaaattatatttataacccagcacatctatctttctcagacatatatacacttaagttatggtacttatctgaatttttatgtactggtaatagtagatgtgattgggcttttgaatctgtgttgtattttatgcgtgtttcaaactatgaattacatgaattcatatatatttatctcccttcggtagctcttctttaattttgcagtggaaataaatcatttttctccactgcatcttattgacactgggtttgaaactctgaagctttgggggtagtagtttacaaagaatgagttttattaactaaaatttatttcagaaaaaaagtagaagtgtacttgaaaccactcttcccatttttccactcagcaatttaagccctcagaggattcatgctgtagggaacttttctaataaaccatggtttctctttttttattttattttattttattttattttattttattttattttttttttgcgacagtctcgctctgtcacccaggctggagtgcagtggtgctatctcggctcactgcaacctccacctcctgggctcaagcagttctccgcctcagcctcccaaatagctgggactacaggcgcccaccaccatgcccagctatttttttttttttgtattttttagtagagatggggtttcaccatgttggccaggctagtctcgaacttctgacctcaggtgatccactcaccttggcctcccaaagtggattacagcactgataactaggcagctagctagaagaacattttatatatccatatcagttcattttccttacccctagacactctatcatagtaccccccctccattctgatcttatgtgttaaataacttgttattcaagaaactaagtaatatgtgtttctgtgagatttagcattctgtaattgtattagcaaatgtggcttttggatttaaagaatgggtgaaacaacaatgactaagtccctggcctttatggaaatggcattattgctagctgatcatctgcgggtggtgaacatggtaaattaataaatggaaacacaatattaatattgactatattgctcactaagagaatctcagccttccaaacatagcttccataggaaaaaacagtagaatcaaatttaagttttaaatgcttctttacttttaaaattcatgatttatactgcttatcaaatattttaagggcaagatcatgacttttcactttactgaaaatagcaccagtgcttatttgactagacaaatattctaccttccttgtaatggggaataggaataactttttgaattactaggtgttccacatagatctgtaagtggaatatataaaggctttaataaagtagaataacttttaaacctgtagtctggatacaagatttttgttcttcaggacaatcccaaggtgaaaaggtttgtggattgttgttttctttttttttttttttttgagacagagtctcactctgtcaccaggctggagtgcagtggtgagatctcggctcgctgaacctcctgggttcaagcaattctcctgcctcagcctcctgagtagctgggactacaggcgcgcaccaccacgcccagctgatttttgtaattttagtagagacggggtttcaccatgttggccaggatggtcttgatctcttgatctcgtgatccgcccaccttggcctcccaaagtgctgggattacaggcgtgagccaccgctcccggccagattgctgttttttaatgttttgtttttgttttaataaaccatggtttctctttttttaatttttttttttttgagacagtctcactctgtcacccaggctggagtgcagtggtgctgtctcggctcactgcaacctccgcctcctgggttcaagcaattctctgcctcagcctcctgagtagctgggattacagacatgtgccaccacgcctggctaattttttttttttttttggattttttagtagagatggggtttcaccacgttggccaggctggtctcgaacttctgacctcaggtgatccgttcaccttggcctcccaaagtgctgggattacaggcgtgagccactgcgcccagactataaaccatagtttctctgtaccaaaagtggtatgtccttcttgagccaggaatatttcactgttcttagtttacctgttgactctgaacacagtttttcatacactgtaaataactctcccaggctgccatcttggaatatgcaaatctgtcgcatctatgtagttatgcatatcgcatttttgtcaaacttttaacttgcatttcttactgtgaaaagtcagggcagggattctatgagttttttctttaaagttcctacaatgaaatgttttgattaaaccttttttggcattcaaattgagattgatttaatgatgtgtgtagtaggctagaaattatgatgaagtgacgatgccatccttatttatcttcagcattcacatctaaagttttaagaagaaaactggcaaatccacctttttaggcttaccatcctcagtccctgtggctttgggtttttttgagaaatttgtcaaagaaacgctatgttagaatttgacattgaggaagccaagcatatttcctctgaatagataatgtgaaatgtgatataatgtattagaatttcatcttcactttggcaagcaagatacttgcaaccatgttcatgcaactatcttcccttattgcttttctcttcttaaccttggttctaaagttttcttcttattgtattaattttgttatgcttcccatttatatgagtcaagtcaaccttacttgatttcttatatatgagttatgtaaggaaaacttatcttttcttatagaattaggggatgaatgagcagatagaaccaacatgaacagggcgatcctaaaaatcattcaaaacatgtaagctctcccaactctgaataaacttgtgatatcttcataatgaataaggtatactgcctatagtaggaagaggaaaatttattaatgttttgtgcattgttaaagaactacaaatgaattgccgtgtggaggctttcattgttgttgttgtaaaaatgctatgtgtattaagtaagcctttgatggagaagaaaaaacaaagaaaaaatatttaatccttcataaatctgggttaaatatgaagctaattcctgttatttggagtaaccagggttttatctagtttacaaagcatgcaattgcaatgtttaaaagcatatgatttggcctttaatatctgaaaatatgtctatcaaaggccatattatagcgagtgtcactccatactttataagtacggtatatttttaatagaatgtttatgtactggtgataagagatgttactgggtttctaaaccagtactgtattaaggattttatgctattgtaagattatggattatgtgaattcatatatattgatttactttcagtagcttttcaatagaatatctagggtttaatacagcttagaaactaaagcaggaattattcatctttaaaatcctgaccaaagaagtggctggcaagatggctgaataggaacagctcaggtgcgcagcccctagtgagatcaacacagaaggtgggtgatttctgcatttccaactgcagtacccggctcatctcactgggactggttagacagtgggtgcagcccacagagggcgcagaagcacggtgggatgtcgcctcaccccggaagcacaaggggtcagggaattccctcccctagccaacagaagccgtgagggactgtgccctgaggaacggagcattccagcccagacactatgcttttcccacagcctccgcaacatgcagaccaggagattccctcgggtgcctacgccaccagggccctgggtttcaagcacaaaattgggcagctgtttgggcagacaccgagctagctgcaggcgtttttttcatatcccagcgtcacctggaacaccagcgagatagaaccattcactcccctggaaaggggactgaagtcagggagccaagtggtctagctcagtggatcccacccccaacggagcccagccagctaagatccactggcttgaaattctcgctgccagcacagcagtctgaagtggacctgggatactcaagcttagtgtggggaggggcacctgccattactgaagcttgagtaggcagttttcccctcacagtgtaaacaaagccgtcaagaagttctaactgggcggagctcaccgcagctcggcaaagccactgtagccagattgcctctctagattccttctctctgggcagggcatctctgaaagaaaggcagcagccccagtcaggggcttatagataaaactcccatctccctgggacagagcaccacggggaaggggcagctgtgggtgcagcatcagcagacttaaacgttcctgcctgctggctctgaagagagcagcagatctcccagcacagcactcgagctctgctaagggacagactgccttctcaagtggggtcctgacccccgtgcctcctgactgggagacacctcccagcaggggttgacagacaccctcatacaggagagctctggctggcatctggcaggtgcccctctgggatgaagcttccagaggaaggaacagacagcaatctttgctgttctgcagcttctgctggtgatactcaggcaaacagggtctggagtggacctccagcaaattccagcagacctgcagcagagggttcctgactgctagcatcaacatcaacaaaaaggacgtccacacaaaaaccccatctgaaggtcaccaacatcaaagaccaaaggtagataaatccacgaagatgaggaaaaaccagcacaaaaagcctgaaaattccaaaaaccggaacgcctcttctcctccaaatgatcacaactcctctccagcaagggaacaaaactggatggagaatgagtttgacgaattgacggaagtaggcttcagaaggtgggtaataacaaactcttacgagctaaaggagcgtgttctaacccaatgcaaggaagctaagaaccttaaaaaaaaggttagaggaattgctaactagaataaccagtttagagaggaacataaatgacctgaaggagctgagaaacacagcacgagaactttgtgaagcatacacaagtatcaatagccaaatcgaccaagcaaaagaaaggatatcagagactgaagatcaacttaatgaaataaagcatgaagagaagattactgaaaaaagaatgaaaaggaacaaacaaagccttcaagaaatatgggacgatgtgaaaagaccaaacctacatttgattggtgtacctgaaagtgatggggagaatggaaccaagttggaaaacactcttcaggttattatccaggagaacttccccaacctagcaagacaggccaacattcaaattcaggaaatatggagaacaccacaaagatactccttgagaagagcaacccaagacacataataatcggattcaccaaggttgaaatgaaggaaaaaatgttaagggcagccagagagaaaggtcaggctaccccaaaggaaagcccatcagactaacagcggatcatttggcagaaaccctacaagccagaagagagtgggggccaatattcaacattcttaaagaaaagaattttcaacccagaatttcatatccagccaaactaagcttcataagcaaagtagaaataaaatcctttacagacaagcaaatgctgagagattttgtcaccaccaggcctgccttacaagagcttctaatgaaggaagcactaaatatggaaaggaaaaactggtaccagccatggtaaaaacataacaaattgtaaagaccatcacactatgaagaaactgcatcaactaacgggcaaagtaaccagctagcatcataatgacaggatcaaattcacacataacaatattaaccttaaatgtaaacaggctaaatgccccaattaaaagacacagactggcaaattggataaagactcaagacccatcagtgtgctgtattcagaagacccacctcatgtgcagagacacacataggctcaaaataaagggatcgatgaatatttaccaagcagcaaatggaaagaaaaaaaaagcaggggttgcaatcctagtctcagacaaaacagactttaaaccaataaagatcaaaaaggacaaaaaaaatggtattacataatggtaaagtgatcaatgcaacaagaagagctaactatcctaaatatatatgcacccaatataggagcacccggattcataaagtaagttcttagagacctacaaagagacatagatgcccatacaataatagtgggagattttaacaccccactgtcaatattagacggatcaacgaaacagaaaattaacaaggatattcaggacttaaactcagctctggaccaagtggacttaatagacatctacagaactccccaccccaaatcaacagaatatacattattctcagcaccacatcacacttattataaaattgaccacataattggaagtaaaacactcctcagcaaatgcaaaaaaacagaaatcataagagtctctcagaccacagtacaatcaaattagaactcaggattaagaaactcactcaaaaccacacaactacatggaaactgagcaacctgctcctgaatgactgctggataaataaggaaattaaggcagaaatgaataagttctttcaaaccaatgagaataaatacacaacggaccagaatctctgggacacagctaaagcagtatttagagggaaatttacagcattaaaatccccacaggagaaagcaggaaatatctaaaattgacaccttaacatcacaattaaaagaagtagagaagcaagagcaaacaaattccaaagctagcagaagagaagaaataactacgatcagagcagaactgaaggagatagagacatgagaaatccttcaaaaaatcaatgaagccaggggctggttttttgaaaagattaacaaaatagatagactgctagccagactaataaagaagaaaagagagaagaatcagacagacacaagaaaaaatgataaaggggatattagctctcatcccacagaaatacaaactaccatcagagaatactataaacacctctacgcaaataaactagaaaatctagaagaaattgattaatttctggacacatacaccctcccaagactaaaccaggaagaaatcgaatccctgaatagaccaataacgagttctgaaattgaggcagtaattaatagcctaccaaccaaaaaaagcccaggaacagatggattcacagctgaattctaccagaggtacaaagaggagctggtaccattccttctgaaactattctaaacaataggaaaagagggactcctccctaactctttttatgaggccagcatcatcctgataccaaaacctggcagagacacaacagacaaagaaaatttcaggccaatatccctgatgaacatcaatgcgaaaatcctcaataaaatactggcaaaccgaatccagcagcacatgaaaaagcttatccagcatgatcaagttggcttcatccctgggatgccaggctggttcaacatacagaaatcaataaacataatccatcacttaaacagaaccaatgacaaaaaccacatgattatctcaatagaagcggaaaaggccttcaataaaattcaacaccccttcatgctaaaaactctcaataaattaggtactgatggaacgtatctcaaaataataagagctacttatgacaaacccacagccattatcatactgaatgggcaaaagctggaagcactccctttaaaaaccggcacaagacaaggatgccctctcccaccactcgtattcaacataatattggaagttttggccaggacaatcaggcaagggaaagaaataaagggtattcaaataggaagagaggaagtcagattgtctctgtttgcagctgacatgattgtatatttagaaaaccccatcgtctcaacccaaaatcttcttaagctgataagcaacttcagcaaagtctcaggatacaaaatcaatgtggaaaaatagtaagcattcctatacgccaataatagacaaagagagtgccaaatcatgagtgaattcccattcacaattgcttcaaagagaataaaatacctaggaatacaacttagaagggatgtgaaagacctcttcaaggagaactacaaaccactgctcaaggaaatgagagaggacaccacaaacaaatggaagaacattccatgctcatggataggaagaatcaatatcgtgaaaatggccatactgtccaaagtaatttatagattcaatgcagtctccatcaagctaccattgactttcttcacataattagaaaaactactttaaatttcatatggaaccaaaaaagagcccacatagccaagtcaatcctaagcaaaaagaacaaagctggaggcatcatgctacctgacttcaaactatactacaaggcttcagtaaccaaaacagtatggtattggtaccaaaacagatatatagaccaatggaacagaggcctcagaaataatgccacacatctacaaccatctgatctttgacaaacctgacaaaaacaagcaatggagaaaggattccctattcagtaaatggtgctgggtaaaccggctagccatctacagaaaactgaaactggaccccttccttacaccttatacaaaaattaactcaagacttaaacataaaacctaaaaccataaaaaccctagaagaaaacctaggcaataccattcaggatataggcatgggcaaagacttcacgactaaaacaccaaaagcaatggcaacaaaagccaaaattgacaaatggaatctaattaaactaaagagcttctgcacagcaaaagaaactatcatcagagtgaacaagcaacctacagaatgggagaaaatgtttgccatctattcatctgacaaagggctgatatccagaatctacaaggaacttaaacaaatttacaagaaaaaacctaatcaaaaattgggcaaaggatatgaacagacacttctcaaagtaagacatttatgcggccaacaaacatgaaaaaaagctcatcatcactggtgattagagaaatgcaaatcaaaacacaccagttacaatggcgatcattaaaaagtcaggaaacatcaggtgctggggaagatgtggagaaataggtgtgcttttacactgttggtgggagtgtaaattagttcaaccattgtggaagacagtgtggcaattcctcaaggatctagaaccagaagtaccatttgatccagcaatcccattactggttatatacccaaaggattataaatcattctactataaagacacatgcacatgtatgtttgttgcagcactgttcacaatagcaaagacttggaaccaacccaaatgctcatcaatgatagactggataaagaaaacgtggcacagatacaccatggaatactatgcagccataagaaaggatgagttcatgtccttggcagggacatggatgaagctggaagccatcaatctcagcaaactaacacaggaacagaaaaccaggcaccgcatgttctcactcgtaagtgggagttgaacaacgagagcccatggacacagggacgggaacatcacacaccggggcctgtcgaggggtgggaggttaggggagggatagcagtaagagaaatacctaatgtagatgacaggttgatgggtgcagcaaaccaccatggcatgtgtatacctatgtaacaaacctgcacgttctgcacatgtatcccagaacttaaagtataataataataaaaaaaaaatcctgaccaaattatttattcaatgtgaaattaattgtaagttagtgttgccaggagagcttattacttagttaccatgtattccctctcatctcctgctttgtttataaagctaaaagcaaattacttaggacagcaatgtcaaatcactttctttccccaaagcatctgattttagatagcgctgtgtgtgttttaaaagcccctacctcgacttaggcaaacagaaccttcgtttaccatgctattcccatcccgcctttgaaacttctgaaaaggcagagcggagtaattgtttcagacatctgcttagcatactttgaagtgcatataagttctttttcagtttcatttgaaccccagctgtcttcaccgaagtctataatcaatctgaattaagttgtcctacttctcctaataagtctcttattaagttctgcatcagcctcttagggagacttaaaagctaattcatgtagaattgccattttctactaattcacttgtcagctctccaaattccaacaaaaacaattgcaaagactattaatttggctcttcataaacaacttatgtaagtgtagtatacattggaaccaaacaaacgatttaaaacagtgggtgggaggaaatgagttgatggcattcaaaacgcttccttttttgactgttatgaaatgccttccacatcgaaagcataaagccatttatttaataagggaaacatccttctgcttttactttcatagatgagataatgactgaatgaactttgcttaaagacaggaaaaggctttagaacagttggaaaaggaacatgttctttttgtcattgaacttattttaatttggacttctttgtgttattttgatggactgtgataaaagaaggagctagaattggttattattgttattggattaaatcagagttgtacagctactcttctggtcatgggatatttaggagaacacgggtaatcaaaatgttcagctaatgagttcatctgattctactcaagaagtgtttaatcagataataaaaatttctccaaataataccatccttcctactatttgaaaacaaccatatcaacatctgatcctataatatgccaatcctgtttgctaggattttctgaaagctttgtttgtggtgggtaataactagaaatactattcctcaagagtctcgggtaataaaagattattcaaaaaacttaagtaatatactctcagtattagaggatatacaaatgcactcattcattaattcatgatatgattgaaacctatacccagagaagtctgatctcattatagagtgtgaacatttaatttatttcaaaaacaaaaattatattgagagttgtatagatggcatcttagttttcctgggaatattattatttagcaccaagctgagggagcaagaatttgtattagcttgtgtatacatgtgcatgtaccacattaactagaaacagtgctaaaatgtgagttatttatttaactgaaattccatatttcctaagaaaatggaatcacacagccaatatatatttttaattattttttgacatctaccaaagttgtgacaagaataaagttcacaattctgttactctcctaccgttcagtaaaacaggaaatgctttaagatcaaataacccaaggagttcgcttcttcctgtcatgcttgacaattacaattttcaaaatttaacagttagcattgacaccagtattatgccttacacaacctgaaattaactaagttaagtaatggcattgaataatttttcttggtaaatcagttttctgggtattatgggaacagttgtgtctgtgatactaatgtctctctcattttaatggggcctaagaaagaactttttcataataagattttttcatgttaaaataatatttttagttatagtttacacttactgcaggtttttctatttaaaagcatcttccgagagcagtgattcttaaacttatttacttcagttatcttaacagcatagaagacatagcctgacatctcccgcttccacttacctatctcctttttccatgagcatgaaatttctttgatgttcttgttttattttttaaatctcacatcaattttatggtattttccataatggattcatcatgttttaatatgaagatgctttttcttcaaattctgaagtaaggaatctttcagcacattcacctatggacatgaaagcgtaagttgagaatcacagtataaaggattgcccagtttttgcaggctttatctttttccatcaacttctgtcttttatgtacacagacaaaaagagcagacccttgctatttcaaatttatcttttgcaggttcatctgattattgtgatccaaagttccatgactagcagctcttaattttgaacatgtattatttcaagcttttgtgcatagtcacttaactaatgagttaaatggcattttaagtcaggttccatgaacgcagaccctgagaacaggggtctaggtgcctgtgatttatagagggtctgctctcaggagaagcctgtattggagttagggaaacaatacaggagaagaaagagcccagcaagtatgccatttcaggtgaaacctcacattgtgtctgatccagagagagagcaagccctcgagcagaaacctcgctgtggagttgtactctttattttattttatttttttgagatggagtttcgctcttgttgcccaggctggagtgcaatctcagctcactgcaacctccgcctcccaggttcaagtgattctcctgcctcagcctcctgagtagctgggattacaggcatgcaccgccacgcctggctaatttttgtgtttttagtagagatggggtttcaccatgttagtcaggctggtcttgaactcctgacctcaggtgatctgcccacctcagcctcccaaagtgctgggattacaggcgtaagccacaacaccgagccggagttgtgcctttataccagtcattgtctgtgtcactgaagtgctggcaaatatttgtcgactagctctgaggtgggatgaatcctggtgtgtatcaaaaccagttttcgtggtgtaaatactccctctaccactgatctccagctaccgacataatgccactgagtatggaattgggaggagatgcacacaattggctcttgggctctgctgcagcacaccactggctgtggtccactcctgggatatgggttacttcctgggctagggggctcccataagcagaggtcacatgtggagaaggcaggtagctataagacattaatagtcaaccatcacagcagctgaaggatggatgcccaggttaggtaaagtgtcccctgcaactaataagtaaacctagtaatccactcactcttcatattcaacttggctttttttaatgctgttttgtttttgcatgtacagtaattctttataaataatgagaattttgtttctttatggaaaatccacctaccctccaccctaccatgaatagcttgatagctgttcatcagaattagtgatggaagagaagagttaatgaatgaaaaagtctaagaaagtgatcactattagtaagaaaatggcctcataagtgagtttggctttatagttatggaatctgtaaatgtctaggcattcagacatgtccagacatcattgagaatgtcaagaattttcagtggcaatggttctcacctcagcatacatcagaatcacctggagggcttgtagaaactcaggttggtgaaccccttccccagagttcctgattcaaaatgtctggggcaaggctaagaagtcccaacttgttcccaggtgttcatgatgctgctggttcagagatacattctgagaaccaatattccatagtaaagctactgtgtatgtacctgaagacatattttgtgtagtgttagcgtttcttcaattacaagtaataaatatatcatttattatttcttttatatttatcaatatccagaagatttagtttaaaaatgaatgcaggcacacagcctcttgttggattgattaatagtttagatatgggagcatcatagggagcattgtttcgcttaggaaccttgaaatgaataaatggcttcttttctaaatctcacttgtggaagactttgacggtggtttatttcattttttcctgttggtattttaatgacactggtacaattttggggttgcttcagatgaccaacagcataacttgccttcccagtattaatttttaacgttaaaaatatttagtcatggccggccgtggtggctcacgcctgtaatcccagcactttgggaggccgaggtgggtgggttgcatgagctcaggagtttaagaccagcctggacaacatagtgaaacctcgtttggacaaaaaatacaaaaattaaccaggtgtggtggcatgtgtctgtagtcccagctacccgaaaggctggggcaggaggactgtttgagcacaggaggttgaggctgcagtgtgccctgttcactccactgtactccaggctgagtgacaaagcaagaccttgtctcaaactatatatatatttagtcacataacttttcactttgtgtaaatattttttgcatttaccaataaaaacaattacatttaaaaattctccttacacttttctaccaaacatactgatgataaaatagtactttatagagtttctgaatctaggatattaaaaatagttgggatcagtcaacactttttaagtaaaatctacttgctagatatgaatagctaacagcttctccaggagtgcctacattttataacttactttgtccaccccttgaggctctgtgttcagggggagggtatatttttgtgtatagaaatagagatgaggtgaaatagagatgaaatagagatgatgtgggatcaactgggagaaagtagaaaagagtcttagctgaagtggttgaggaaggaggatttttcccaaaatggtgcaaaaaacaatgtattaaatatctgtgaaaaagttcatggttgtggtatagggtgagtggtatatgaaaagagaattatgggataaactaatggaaacagatgtcttaaaatttgcttttaactttaaacaagagacatgaaacttaaacttttcccttatcctagaatctgggagaggagaaggatgagaaaaaatgaaattttacattagaagcaatttgattaatgttcaatggaaaatggaaatagctatggtcaaacccactcaaatcaagtgtacattaaataattgagttaactgaattaggcagagtaagggcacattgattttcagtgttgttgaaaattggtccacatatcattgttatgctttttgtttgtaaacctcaatatttattaagtttccacagtgtgctcagccctgaaacgccaaattctcttaaccagaatgaggctggaggatctaacactaagacagatttctattttcttttaaggaattgatttttatggtaattttttttcttcataaagttaagaacctgccagtcctgtttcgaaacacacttatttttagaagtttggttttccgggattatgcatcattatagactcaaatgactcatttagaacttttccctatcaaatattcacattctatcatcatgatcttaacacggcataagcaagttagtgaacagagtgaagtcaatttattggcaatatatgccgaagtacaggaattaagtagaaacaaaagtgaatgagagtctttggcaatacattgatgtgttttttttagaaccaatgataaactactgctgagtttcctttcatttacttttttcctactcttaaaacattgtaacccattttgagatctatccattgttgtgaacctaaagcctattaggtcttattaaataatacccatttaactgacctgtgatttaagtttcttatctgcccccaagcaagcagactgtatgcaacggcattttacctgcttcaccttctgcttgccagttggtttttggtcttcacatgtttctagcagggatggggctaaagcaagggagagaatggtccattgttttagactttcacaaacccaatatactagaatctccacaaaggttatccaatatcagggtgacttttgtgcatccaataaagcataaggttaaaagaaatacaggctaaacaaatgagcataaattactccgttggcttatgctgtgaataaaatattacctttggaaccatctcaattttttttttgtataaaggttgaaggaagacatttgcaaagtcgtttctcctataaaactgcctagggtttggggttgattgttgtatgcaagaggggtcttggtgaaatctgacccactttgaatctaaaattactgaattattagtgaaaagattattttaaaaagagttttgaactctttttcctactgaaattgtattctcctttagataatcaatgcagcatcacccccacagatttttgagggcactaaatcatactcctattttgaaaaagaaaaaagtctattactattaaatatatctgttagttgaatatcaatcactttttctaaagggtagatttggccaatgagtgatttttttttttttttttttttggaaatcacatctgagaacgttgtttagacagcttgacacttagactcatttgtgtaagtagtaatttattcatcatttgcatgtacttaactggacattatcatgatagcagttgtcataacagactattacaggatatgaatttagatattaccttaagatgtgatcataaaaatcagaataatatcttgaaaatatcaattttatggtgagaaaaatgacaaactgaataaactcttgactcaagaagctagacttttcacaacctcatgtattcacagaagtaaaaataacaactaataatgtgtccagagggcccacattgctcagaaatgaatacataagactttcttttcagcctcagaatatgatgaaaagaagatgaaccattatgatgttgcatagattttaatgaagaaaattcgttttctgttcctttcgtttgactttaagtagttgaacatcctgcttttttattttgtttgcaagaaataagaccattttagaaaggctaaaaacattaattacatttaggaactacaataatctgaaagtaaaattggatattaaaggacgtttttgcaatcctttttagccctcttctgtgtattatttttatcactgctcttaaaaatttgtattaatctttggttcatttctgccttagtatttctaagttaataatatattgaatgaaaaatcaaatcagtaaaaatccattttgtttcagtagtgagtgccttccccctagaaccaaaactaaataaatgtgctccatataaagcaaaccaggtacagcatattgcacgggtaactcacaattctagattcctctattaatcattattcagacatgcagaggtagcttaatttgctttaataagtgaaaacagaatctctttgagactgctatctgcaatattatactttgtcctgcattttcttggtcaaaaattgtattttatagccatgatatattttggcttggaatttgcttctttataagcctagttattaatagtcatcatttaaatgaaatgatatccattagccttaagctgcatgattacagagacttggtctatcttacgctgtatttccagtgcctagaacattccctggcatataataggtacccaataatagtttttggaataaatgaataaacaaatttgtgcaaaagcatagggcaaaatgctatcttttagatagcgtgacccttaaaaattattttgcaaataatttgctccatttgccaccagcttatttctggccattgttacttcttgtctctgcatacaaacactctgtgtctcttctcctttccacaatgaccacaagttatactgatctacttgagattttccaggtgactatttcatgtccagaggaacatgcctcttctagtgttcccctctgtgaatgatttcagtcaccttatctactcaggaggtctctcttcccctccatcagcatctttctctgcaccttccaaacccctatgactcaacttctcataatatggattgcattttttttaatgacccattaaattgtgtacctctgctaatgattgtgagtgtgttgagacttccatttttccagtggatgataggtatataatatatatatatatacacacacacacacacacacacacacacacacacacacacatatatgtgggcacagtatctagtggatataaagtaagtgttttcaagtgagtagtaattaaatctaagagttgccgagaaaatgccattcccgttttgtggacatcttcattctacattgtaaaggccacctcattcaagacccaccacaatcttgatcccagaaaacacccatgattcatcttttacagctgccctgtacttcatattttaagttattaaaggctatttgcttttcctcagacacacattaaactttcctacctcttaccctttgttcaagttctgaacacatatctttcttccccacactatgcttcctctttatcagtttcatgtacctactttccaatgtctagttcgaggagacgtttataaggctacatgatagaggttgcccctggggcgatgtgagaaatcagctccaaaaaggtagctacccggcaaaggatcttagtctgtgactctctcatggatgaacttattacctactgctttgcagagtctccctggactagcctgaataggaacttgtgtgactatatgtgaactaaaagaaggagaaatatgcctaaacttctcatccatctttgtaacagccctaaagtatgcatgttactatcccttttctacacaagtggaaaatatttgtaaatgaacttcgttacagtctaatatttgatgacttcttagttcatatcattatttaagtaacttttctttagtggaaaagcccaaaaattagggaggcagggagagagagagagagagagagagggatcatctgtaatctcagccccagcatctataatcccaatccctgcaagggcctctttgggcaaagaagaaaaaggcactgtgtttttgaagagatccccggtcctatgccaagcctaaccaatttggtagtagagcccaggctggatttcagttggtttgtagtcttctagtcttttcatatgtaaatatttttaatgcttttattcagtgttgttaaaatgccctccaaaagatgcactaacttgtgccaccaccaccaagcagaatatattttccttgaataggctacttcctctttttttcccactcactccatttttattttaaaaatccctggtagagaccaaaaactgaaatgttatattcttgcccaaagaatgagagatgcttcagaaattagcaaatgctccaatataaatcaagtgatagatataaataattcagatatgggataaggaaaatgggtagctttctcttatttaggaactctatgtcaggtttctgtgagaaactgtttacgaagcagtctgacaatagctattggtctgaagtattagtaattagtacagaagtgcctaattctcttgactgcttgttctttaataaaaatgtattgagggattatcatgtactatggcttggcatatactggtgaaaaacaataatgtaggattgccttaataaattttctggtcttgggaaggaacagacaatgaataaatgaataggcaaatatatatgtacttgcaaattgtgatcagggttcagaaggaaaatagggtgttgagagtcaaggaaaaaggagacactttacgtagggcaaccaactgggaataggctatctttaaaagtcacatctaactgagatcagaagtatatgaataagagccagctaggcataaagtggatatataaaactccaagcagagggaacagtgtatctgaaggttctaagtcaagagtaagcttgggccaggcacggtggctcatgcttgtaatcccaacactttgggaggccgaagtgggaggatcacttgagcccaggagtttgagaccagcctggaaaacatagagagatcccatctcgcaaaaaaaaaaaaaaaaaagaaaaagaaaaaactaacttaaaaatatatatatatcaatgccagtggtgtgtgcttgtagtcctggctaacttgggaggctgaagcaggaggatcgcttgagcccaggagtttgaggctgcagtgagctatgatcgcactgctgcactccagcctgggcgacagaaagaggccctgtctgaaaaataaaataaaaataaataaagaaataaaaagcttgatgagttctaggaactcaacattttctaacttcttattagaaatgccaaattctcaggcccaccttacacccactgaatcaaaagcactaagtgggactcagcagtctctgtgttaacaagccttccacatgacaatgagatgcacactattgtgtgagaatcactgccttagactgatgttttgagctatttaggggagggagagggcccattcagggacaatggtggttaacacatgtggctcagaccaagaaatgattgcaagcccaaaaacttgttaaatgtaaaacttcaggcgcagtggctcacgcctgtaatcccagcactttgggaggccgaggcgggtggatcatctgatgtcaggagttcaagaccagcctggccaacaaggtgaaacccagtctctagtaaaaatagaaaaattagccaggcatggtggtggtgtgcgcctgtaatcccagctacttgggaggttgaagcaggagaatcgcttgaacccacgaggcggaggttgcagtgagcccagatcgcaccattgcactccagccggggcgacaagagcaaaactctatctcaaaaaaaaagtaaaacttcatctgtctgaagtaacttctgaatttgaagataaacatcctcatggttgatattttaatggtttatggattattacttacttttaaggaagttaataggtttcattaactgccattttgcttcattttgtcacatataattaaaatttttcagacagaaaatattggtattttttctgtttccttagcaacctaaagcatgacctgcttaaatgacttatttgtgctcattaaaagcctttttgtgttaattgtgtatattttgtatttagcctctgtgaaacactcatgaactatctttttatttgttttaattgtgtcattggaaagcttgaagtattttgtggtttttttttttttttttttttttttgcttgttttttgtctataaaggggagataactggcagttgcagttaggattatagaaacattttcccaaggaaattaataaaatttgttcaagtttcttcttttacaaattgtacttatttttgattttttaaatagtggtaaaatacaaattacatgaagtttactatcttggctctatttaaatgtatacttccatggcattacatacatttacgttgttctgctgccatcaccaccatccatctccagaactcttctcatcttgcaaaactgaaactctatgtctattcaacgataatccccaccaggcatggtggctcacacctgtaatctcaacactttgggaggccaaggcaggcggatcacctgaggccaggagttcgagaccagcctggccaacatggtaaaaccccatctctactaaaaatacaaaaattagctgggcgtggtggtgcacacctgtaatcccagctacttgggaggctgaggcagcagaattgcttgaacctgggaggcggaggttgcagtgagctgagatcgagatcacaccactgcactccagcctgggcaacagagcgagactccatctcaaaaggaacaaaaaagaaaaaaccacagtaattccccattgcttcctgcccccagcccctggaaaccaccattctatttcctgtctataaatctgaatactcatttctatatcttctttggagaaatgtctattcaggttacttgctcattttttagtcaggtgatttgttttcttgctattgagttgtaggagttccttgtgtattttgaatactgaccccttaccgggtgtatggtttgcaaaatatcaattgctcctgctatgttcaacttgttcttaaaaataaaaacttttcctttgtggtcaatacttccctgttcctcatttccaaattttatacatgaaggaaatgtgagcacccagaaaagaaagaagatagacactgttaatatggccaagatataattcggcttttattataagaacattggagttacaagcttcatagaaagccatgtcctaaaagatgaagaattatgatcagtgcaaagagaaaatgttaaaaagaaaaagttatccttttatgtttgggtatatattctttttcgatattgtaaagagaaactagagttttttgttcttgtttttgagacagagttttgctcttgttgcccaggctggagtgcaatgttgcaatctcagctcactgcaacctccacctcccgggttcaagcaattctcctgcctcagcctccagagtggctgggattacaggtgtgcaccaccatgcccggctaatttttctgtttttagtagagacagggtttcactgtgttggccaggctcgtctgtaactcctgacctcaggtgatccacccacctcagcctcccaaagtgctaggattacaggcgtgagccaccgcacctggttgagattgttttttataaaaagatgtggattctttatggaaaacacagagcagttaattgctatttttttaatgtcacaaatttggaagcgtgttgagtctgagaagaaaccatagttaaaatataattactgataatcgcttgggaaataaaagccctaaatttcttcatgcctacaaacttaatattgttttcccaagatcttttttttgactttaacctttcttaagtgtttctgattatgctaaatctaggccattagttctgagtctgtttcattatttatattgttattcagtttactcgtcaaaagtgatcatgcccaaatatgaaagtttacaagaattgccctgaaaactgaacggaaggagacaacgaaaagaaactgcataatattttgccttcaggctatcacaataaaaactgttgctggaaaaaaatgcaatcacatcccttttttttttttaaagtacgtttcaatggcataatttattgtcgagaatgtctctaccagaagcataagtgatactaaaggcagagggttgtattcgctcagtctgcaaagtatcccctttgtcttagctccacacagtccctcagaatttggcagaaatgagggactcaactttcgagaaagggtgacaatcccagttttgttggagagctatgaaatagccccatagtgttagtaatgaaaattcacttaagaagtctcctgcaggcccggcacggtggctcaggcctgtaatcccagcactttgggaggcctacgtgggtggatcacctgaggtcaagagttcaagaccagcctggccaacatggtgaaaccccatctcttctaaaaatacaaaattagccaggcgtggtggcgggcacctgtaatcccagctactcaggaggctgaggcaggagaatcacttgaacccaggaggtagaagttgcagtgagccgagatcgtgccattgtactccagcctgggcagcaagagtgaaactccaccttggaaaaaaaaaaaaaaaaaggaaagaaaggaaggaaaggaaggaaggaaggaaggaaagaaaaaagagaaagaagtctcttgaaaaaaagaaaggaagaaagaaagaaagaaagaagtctcctgtataaaaaaaggaaagaaagaaaagaaggaaggaaggaagaaaagaaaagaaaagtctcctgaaaaaaaaaaaaaaacaaaatataagtgcttgacaactgaagttcaagggtaaaggctattgggaaagcagatgaagttaatctaagtaatggatgctgttggtgccccagtcagattcgttcactgggttggtgcacccattcctcagtgactctgagtattagctgctaaagcctcatggtttcacccctttccagagaacctccctcagccaaaaggaagccaccttgactggcatgtcccaccacaccttctctcttaaaaccaccaggggtacaaagggaaaacccctttgcctcatcatggcacctgctgttgtacaatttgtgatctgggaattcccatggggccagattgatgctggtctccagcccataccacatcccaacttaactttcttgccctgtcttcctgcttctctcactccctttttcttaagagcactcagactctgcttctcttaaacctggctgaaggcagtaggtatctgaaagaaaagctgtacctacattctgggcatcagagcagtcagggaaccaaccagaatgaaaagtcaaaaattacagataatgatggaagtctctgagcctgatacatttcatgaagggcttgcttacagctcaacttgtgtttctttttaattgtttcaacagcatttgagtagctcattccgcccaggtatttgagagattccagtaggcctctgatcctctggaaaaagcaagatacagtccttgactctcttggccccatgaggatgatatatctgctgagaaatgcaggagctgcaaaacatagctgggctgtacctgctgccaattcccgggtaattgcattctgtgagggcttccctgaaccacgaggaagagccccggaataagtactaaacaccagtatttataggacatgatttctaattgctcatccttgccttctcatgactagctcagcatgaagaatgctgggacttttctttcctagcacctcctctttttaggctgttttccaagagtcttggttaacaaacatttgtttgacaaggattcatggtagacagcaatgccattagtccctacttaagtaatatttgtaacataaatttctctgcacgtgtatgtagcccaagaataacacttcatttttggaacctagtaattttgaattcctagtaagtgagataggacgtctatgagttagcaggttaagattttaggaggaatatttaatatccctaagaagggaagtttttcaaacactgagtagcactatatatatttatatatatatagccagatttctatctatctatctatctatatatatatatatatatatatatatatatatatcacaccatttataaataaactcataagtggcaaatccagtagagctaatctgagcatcccagagtctcccctctctgtcgcttgtttgtgcagctactcctgctgtggccttttatggattatcctggacttctacaactgacccctctactttctctccatctacaagcttcattttgctttgctttcctcctaatccagtttagattccacagtatattttttcaattacatcctggctaatatcgaaactcccttatccctaaatgtgtgagccacagtcatctgacgaaaccccaaacctggatcaactgttttccccatgcttacatgcaacactgttggagaaaatgagaaagtcaggcagattggttctgctaaaaaatgttgaacctcatcctcaagtgggccctcaacactgtttgccaacctcattacatctcttaggtcaactccctctcacagtctctattacgattaattcaaatgttcccacttacccttaattcatgttttcattcagtgactattcattgcacaccaggcactgcacgctatgccaggcactgcagactatgccaggtctgttgattcctacttcacagaggaaataaaacccctccaagcagaattccctcaatttactctttctagtctttccaactgaccttctgtgctttgcagtaggaatgttctcttaactgtcaagtcaaaattcctccctcaaaaataagattcccttgttaatagacaattcctttattttcttagaaaagtagtagatgactataattttaaatgtgtatttgaacaaatccttagctacataaagataagcaaagatatgacaggcaatttaattttatatgaagaaaaacttattatatcagacttacctatcattctaaatcagtacttttgtatctataatcagacaacatttaatgaactgaaaattctgcctgtgagaaactagtcataataaaattagacttggtttgctctttcatggagaacatattccagatgtttaagtgattcaaagaaaacccacaatataatggctttcttcaatgttttctcacttactgcttccaaactagaaaaaaaacctaatgcaatcctgatatcacttaaatagcacctcgtattgctcagcgttaactgtgctttttgacattttaggtgtagtgtttaataatttaaacacaaatttatgtgtgtcatattaaaagctctaatctgtgaaatatagccaaaccaatgtcacatctatttaaatagcaaagtacctgtgttcaccctttacagggtgaaggtcttgtgactctgtgtttaggcggccatacttcttgttatgtatgctgctgggcactgagagcccacagtggtgagccatccttgggtggtaaaagctgctaccaaaacctaaatcaaatgccaaagtgaagactgacatgagcattctcctgcctccttttcctttttatctttcctaccatctgttatctcctttcttccaccttcatgcgttgagtgccctcatgatgatttctagctgactgaagtcctttagtctgctcaaccccatctagagacttccccaaagtgaacctttgcccccagttatctgtttatcaactgacctcacaccagtcaaagcttccattgtcaaatattttaacagaaatttaggaattcagattaaactgaatatttggcattttttcttttttttttttttttttttttggagacagagtcttgctgggtcacccaggctggagtgagtgcagtggtgccatcttggctcactgcaacctccacctcccaggttcaagcgcttctcatgcctcagccccctgagtagctggtactacaggcatgtgccaccacgcccgaataatttttgtatctttagtagagacagggtttcaccatgttggccagtctggtctcgaactgctgacctcaagtgatccacccatccacccacctcagcctcccaaagtgctgggattacagtcttgagccaccccacctggtctgggttgttttcttcatctttagcagttgtcttgttcacaactacttcaacaatatttattttctttttctttttgaagcaactctccagagtatttggcctggtttttatagaaataataacttttttcttttctttttaaactaatatttttatgatttaggaaatctttctttattaaattacataatcacaacagttactggcaaagataggtttgagaacatacacacaactgacggttgtaacaagtcaactgatgggagcagaaggtccacacatactgacaggcacctcgaacattttattgaggctgtgagaggttcccatcactgctgtttcacaaagagaatgaagactttggctaatttggtgagtcttaagtggagattagttcagagaacttccactatcattgcttgaaagaagcaaaaaaaaaaaaaaaaaaaaaaaaaatcccaagatcttatggtaaagtttaaagaagaaaagtaaattttaaaaagaaaaaaaaagaggaaaagggagagcattgcaattaattatgagtaccaaaacttatttttgaatccccttcatcctccaaaacattgaagcaggattaatatgtgtgctcaggaatttgggagagaaaatgaaaatcaaaatattctaataagagacatttgaaaatgtacattgtgtcacctaaagggaactgaaatctagctatggcttaacgaggtaggataatcaacttaatggcttgagagtcttgcttgtaaagagagatgattagcacaaaggactcacctgtatcactgaaagatgctgcctgctggcttgccctctctgcagaggttcctgtttacagtttcccctcacatgatatttatttgtggctactagaaatgcacgttattatccagaagagaatgatttcattttgtaaccgttgtccttgtccaagtttcccccattgacatttaagaaatctgttttctaacctttctattatgcaaaacaaaattaatatggatcatttccttttagagataagtattcatatatatggatttaaaccacctttctccatgggcccttattctgatacttttaatccatgtatttattcataaggaaatggaacaatatttactatccacccctataaaactttctgaatttcacactgattccagtgacattccactaacacgaagttgaatacagatgaatacatcacatatgattttttttttgcatgtgtatggtcagaaggggctctcttttgtttgtttttattaatatataattcacatactttaaaattcactctttcaaagtgtacaattcagtggtgtttagtatattcacaagattgtgccaccatcaccattgtttaataccagaacattttcgttatcgtccaaaagaaaccccctgattgcttaacgtaatgtttttaatgaccactttttaaaactttaagttcaacagagtgattatcacaatgttttgtattatctaagaactacacaacagtgttatgctctatacagcaccacggtttactgatgaagtattcaggttgatttgagaggataatgtcgttcttattttgaatgttcatactggctccttttatttggagtgggaggaaatgcaaggcttataaatgaggtcagtgtaaccaatggttttatcaacatagtgaaccagacagagaaataacacctgcccagatcaagcaagtcaaaacaacacgtatagtcaagtggtgctgtccttgtacacagacattacattacacaaactgttctcctaagtgagggaatttgtcccttagaaattgcttattggaacatttggacatcatgcatcatgttaaagatccataaatgccatctcgatagggtagatatgaggcgtggtaatatcctccccatatctgcatagggttcttctgctcaacggattgctatgatgtattgcatcagagactcctgctctagtgcttcaaagacagctgagaagccccacgggagccttctgaagtcattgctacaagggctaaaataccaggagatcaggaagtcattctgaggacttgacaaaataccctactccctaaatgaaactgttatgatgtggttggtgcaaagtatgcatgcaatattttatgactgaatatatctttctattgtaaaaaataaggatccatttctggttgtgacatgagtagaatttagaatccagcagcaatatatttttcttgttactttgccaatccagaatttcttaggggaagcatataacataatagttaagaatatatattctagaggcaggcaaacctgcatataggtatcccaggttcctcaatttttacccatgagagcttggcaaggtttgtttgttttgaaaacaaacctctgcaagtttgttttctcatgtataaaattagaattctccaactactggcctcataggattgttgggtagaaataaaatcagtttatgtatgaatagagctcatcatggcattaggcacctaggaagtgctcaacaaatagtagttatcattattcccccattaacaaatatccattgttataatactaccacaagagactgtcttagtctgttccagctgctataatagaaatgccataaattggatagcttgtgaaacaacaaaaacttatttctcactgttctggaggttgagaagtccaagatcaaaataccagcagatttggtgtctggggaaggcccattcctcatacaaagcaccttctcactgcaccctcacatgctgaaaggagctagctagctctctgaggtctcttttataagggcgctaatcccaaaaatcacctccctaaaggccccatctcctaataccattgccttaggtgttttgatttcgtttcctttttattttttaggatttcaacataggaatttgaggggggacacaaacattcaaaccgtagcatagagcaaacattactggcactgcaccctaaagagaataagcccaggtatcagttcttcttgttttaaatattctcatcttccaatttgcttttgactattgcacacaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtaagcacattgtaaacattgttgtcctttgttacagtaaaataatatacagataaaatttgtaaagaacaatgaaagtacttttttcatgtaatgttcatggtaatatttgtgaggataggatattttatattagtttataattcccatctaaacattttcaaattattaatattaattttggaagcaactaagacttagtatatgtcttagtctgtttagtgttgctataaaagaatacttggggctgggtaattcataaagaacaggtgtttatttggctcagttctgcaggctgtacaagaagcatctgcttctggcgagggcgtcaggctgcttccactcatggcagaaggcaaaggggagctggtgtacaaagatcacacggcaagagaggaggagaaaaagagggaggggaggtgccagttctcatgaaaactgctagagcaaaacctcgctcactaccgtgagaatggcaccaaaccattcatgagggattcactcctacaacccagacaccttccactaggcctcaccaccaacacgggggatcagatttcaacacgcgagttagagggaacatccaaactctgtgtagcagtattcttacgataaacagaaaataatgctgaatcatgatggaagatgtgaattgccaccatgcagttcctttgtactcttactgcttggattctcaaaaacatctttccctttagaatcctaatttaaacaagagtcaatagtaagatgtgtccaaaagtcatttaaagaaagagcatcctatcacaaacttacatgtggaagtttttcgtaggtttgcgtaataaatacaggcaatgtaagtgtgctgctcaaggtcacacttactagccatgggacctggagcaaattacttaacctttctgagcctcagtctttcatcaaaaaaaaaaaaatgcgataataaaattctctgcaatatcagtttattattaggatgaataagtcaaaataaatggaaagtgctcgggagcgaacatgccaaatgataaacactctacaaattctagctcttgatgttgttattattattattattacagtacacaggttttggaatccaacatattagctgagtgaccttgaggccacttaatctctgtggttgtccatttactcatctctaacatggttactgtaacatcgaatgagttaattcatgcagagtaatggttgtagtggtggaagaggtgcgtctaccttctcagtgtgaaggacaccatgttataccccaaaaccctaaaattagtttaaccgtagaattagagaatcattttctctcctttccaattttctcctttccaacaggatgcagaaggtatgcctctgaggaaactgggtttaaaactatttggttttaactttttaataagaaaaatataataaaccaaatcactttcctattgtcagtccatttaggggtgtgattgagaggcctgttaaagaattgctagatctttaataaagataagttgcaaatcccagacctcttgagatctcacataatttaattcttgttgtgatggatagtcctgaaagatttgtattctagattgttataagtggcatcgactaaagcaaggcgatatagctaagtgattatatgcctttctctgtttgctccatagtagttgagtactattaaaattttatctgttccatccttagtatgtttttcatcttaagtataaataaggaaagtaataaatgtccaaagaaaaccaatggccacattagtcccatataagtgttctagaagtatattttataatttcttttagagagcagaatgccacgtttgctttcagaacgtggtaaaagatttgtgacagtggcaggtagatttccaaatgaggtcaaaggattatgactagtaagaaaagtttttttttttttaatcaatgctaagtgatccattctagttgcactatttatttgcatttaaggtatcaaaaacagtaaatagcttactatgtagccattctttacaatgagtaaaaacttggttataagtacaggaaaacacatgtaaggagatagtatgatatagcgaaaagagcattggattgactattaggaggtctaacttcaaacttaagctcagccattatttgaccgtgttattgtgagaaagccatttaacctctctcagctttaattctcctcatttttaaaatgcagaaatctattttgtctaaggtcacatacagttcaatcttatgattctgtctctagatatctgggggagatacacatttgacagaatttagtttaaaaccaatgaagttcctttctttattcataatacaaatgtggtttgttgaaattatatttctccttgtataactctaacttttaatctcttcttccctaaacccacatatacacagccttctcctattaaacagttcagtttgtggtgtctgctctatattgtagcaaatttcatgtttctatttttgaacatgaccttaaagatatgcttaaaaagtgtttttagcagaaagctgataaatccaaggttttggtttgcatataaccgagtcaagttagttccattcttttctttgatagtaattctgctacattataaatgtgaggccttgttcagaaagagaagaaagcaagaaatgaggttcacatcaagcaatttttttcccattactggaaaagcaattcatacatcctgttgagaatattttatatttagaacaatgtatgtgaggctaacgcattatccaagttctatggcgggaagcttgagcccaccaccattatgacatcatatttttttaaatagtaaatgtcaaaaaagacatatttctatgaaaataaagaatttagtcacaatgctatgtcaatctttaaatcgtgataaaaaccaagtacaagttcatctttgcctctgtccactaagacaaagaacaatcaaaaagtaaagaactctctgggcatggtggctcacgcctgtaatcccagcactttgggaggccgaggcaggcggatcacttgaggtcaggagtttgacaccagcctgaccagcatggtgaaacctcatctctactaaaaatacaaaacttacctgggtgtggtggtgcgtgcctgtaatcctagctactctggaggctgaggcaggagaattgcttgaaaccaggaggcagaggttgcagtgagctgagatcgtgccactgcactccagcctgggcgacagagccagactcggtctcaaaaataaaataaaataaaataaaaatagagaactggagtagtagaaaggcagatgtaaacctgagaaaagaagaagagtcttaaatttgggcaaaatagtataatagaaagattagagttacatactatcaggccgtgtctacttgatatcagaatatcctgggttctttgcattatccattcatttaattttcaaggaaagccatgctagttttttagctgtctgtaatatcagtcaaaatggtgaaaccagttaagggatgtgagcaccaacaatacagtcaaacccagtcacaatttacctatgtatagaatcataatgtatagagaattccaaactgactttgaatcttctaatagaaatgtaagagacattggtttgcctgtttgaaattttctgtgggaatgaagtcctattttcttcctcaaagtagacacattggtatgcatgttactatttgaccatttgactttttgtggtgtaggaaaccatcactccttgcagttagaaaaagtcctcatgtgcattctctcatctaagaatcacaaccttgtgattttgtattatgattatgattacctattatcattattcccttttacgtgtaaggaaaccgaggcttagaaacatgaagtaccacagtcacagtcacataacttgtatcagtcaagatctgagtcaggtttttcgaactgctattcccatgctctttttgtctcctcttctcaaaatcctattacgtttggacttaacaaagcaataatggctgggtgtggtggctcacgcctgtaatcccagtactttgggagggtgaggcgggtggatcacttgagatcaggagttcaagaccggcctggccaacacatagtgaaaccccatcactactaaaaatacaaaaattagctgggtgtggtggcgcacgcttgtagatcagctacttgggaagctgaggcaggagaatcgcttgaacccgggaggcggatgttgcagtaagctgagatcatgccactgcactccagcctgggcaacagagcaagacaccatttccaaaaaaaaaaaaaaaaagcaatactttaaaactattttggacaatacaggtgtaaaatacttcacttttttacatgtatcttcttttttgaaatgattcttaggtatattaacttttaaatcttccttttataaaccaatggattaatgaacccagttcagtgtaccccttagaaatcacacttgtttcaaatataaaattttaaagcattatattcctcattgcctttagaactcagcaattgtactaaaatcagccaaaagtgatttcagtgaatcagctcttaaagccaaactaatgctaatatttgaccaagtagaaacgaatatctaaaccaggtgagaaaaaagttaaaatgatgataaacctttctaattttgaaatagtacacacactgagtaatgcagtcaatctctttattcaccaagcgcaagtagtatataaaggaatattataccatttttctttactcatgagtaaacccacaaatagcacaaaagctgcaaaaacactttaacataaggagtatttgttttattgactgtaggaactcatggaatgcaaacacctttaaaatctgaataatatgaaggcatttccagctattagattctttacatatgtcaaagaacagtatcataaattatgtatgttttttaaaggtttcctaagcttcttccaaagtcatgtagacatcattacactccatctgtatacctctgtggtaacttgctgtcgcagggatctagagcctcatcttttgcaaacttcattccttctttcatccctttgttctttcattcagtcagcactgattgagcatctactgtgtacctagaagacattgtaatgatcctgtttggtccaaggacatactaaacaaaactccctttactgcttatgctatattaagtaaagctttaaagatgggttctcttttattacttccatgatggcccacccctctcatcctttctcagtgttaaaaaccagaaatatacatacttacatactatcataacactgatactacaaaagcagtacccattattatctctggtttacaaattattcaataatttcttactggaaacttggtctatatagtcatagtagtaagctttgtgagaggatgtgatgggatcatagttagctaaacaataggagtatttgtgtggcttcattttaaaaaaactaaccagtttttttccaacaagcaattcttatatcagaaccatttatattctttactttggtgagataggattttctaagcaggtcttttatctgtatctatgtatgtttgttcttaccatcattgagcacaggatttgatcctttaaatgtgttgacagattttgaacattttcctcatatctttcttttttgttttttaatgatcctgtactaatcattttgcattatggggtcacttctggacagagagcctagccatctgctcttacaaataatgtcggcctatcactaactggggataaggagaagacatctaccgatgtctttctagcatgtccttcttgactttttctttctttaagaagactaaaatgattcagcttgtggttctaccacagaactcaggagaaaatgataaatatgaggccattctccaaataaatatgttttcctacattagtggttctcaaattttaacaagcatcaaattcacctggaaggcttattaaaacacagataactgggctccacataccaagtttcaaatgattcagtgggtctggtgtggagcttgagaatctgcatctctaacaaactttcaagtgaggctaatgctgctgaatcatggaccacactttgataacccctgttctatgttaagtacttgtcaggtacagacaaatttaaaagttaaaaaaatatatatatgacttctgtaagacactgtgaagggtttagactctggggaaattaagtataatgccatcccaaaaactctgtgttggaggagtgttcaagtgctgcaggatcatggagaaccaagcacttaacttttctatgaggcagaaagaggaagataaagggaaacgtggaggatgaagggaaactgttaatagatccccagaaacacaatttgctgctatatggatttatatttactgtatttcaaatcacatggtctagaactgtgctgtccaatatgatagctacatatggccattgagcccttcaatgtagccagtcgaaagtgagatgtgtagtaagcgtaatatatacacatgtaatatgtatatgttatatatatgatatagatgtaatatgtatgttatatatatgatatatatgtaatatgtatatgttatatatatatatatatatcaggatgcaaagacttagtaccaaaaaaagaatgtaaaatatctcattatttttatattgattacatgttgaaatgatagtatttttatgtatttgcttgggtaaaatgtcataatgaatttcactcatttattatgattattcaaacttggttatttttcttgaaaatgaatgaagtgagcctgttgcttcggctacaacaatgggcagtgtttctgcaaaatttttacatgtgcctactagaacatttaaaattgtacatgtagcactcattatatttctgttggatagcattggcctaaaagttttcaaaatctagcatggataagaatcacctgcaaagcttgttaaaccaatccgcccccagaaatttagtatcgggtgaggcctgcaattctgcatttctatcatgctcccaggagatgctgtctatttgtaaccacatatagaaattcattcccaaactacagatgatagagttttacagagaggtgcaaaaatatatttttgcatcaagcattgtctgtagcttgaatacaaaattatgttgcccatataccactggtttttgtaagtaaagcagttgtgttacaaagcatacaagtttttatcagctaatagccttttctcaattagcagatactaagtagtacttttattatgtggcaattctccagtttttggaatgttattgagaaatacacagggttaaaacaaattagaaagcacctctcccaaaatactgcagtaagatgtaggaaaaactgctctaacatattctaaactataggttgctcttatgtaaatatttcaactataatatctagtctgatgtgcccactggccagagttttgtaaaagctaaaagtaaaggaaataaaaaaaagaaagaagtatgtgtttgtttttgaaaaggttaggtcacagaaggatttgttgatattaggaatagaatgacccgtgaaaaaaggacaattaagttccaggaaaacatcttttcagtaaggagagaataatcatttatgcttaacctcaactctgttaggaaaaaaaggatgtaaacaaaaccctttaaagaattgaagaaggagagtataaatttaaatgcccaggttagtgaccacccttagagcatactgaggtcaaagcgtactgtcaagcttaagaacatttggttttcaatgtttgtacaactaattgtactttagtcaagaggactgttatcgaaattgctcaggtagccttgaaactaatatggcccaaatattccagagtctgtctttctcaccctaggagaagaatggtctggttttcaagggaattctctattttttttttttgaaggcatcaggatgtgtgaaactacagggggataaatgaacgatgtacagaatgtgatgaaaaaattatatgaagtataaaatgggaatgaagccatcaggagccaaagaaatatttatgaatttaagagaatgaaaagcatattattattttcagatattttataaagtgaacccaaatcattataaagtattaattaggctacttgattgcttgatctttatatactaatttctaatttgttttaatcgggaactatttttgctagttctaaggctagctattatggtaatccatgtaagtgtgtttattattgtttttaaaaatggaatgtgttcctagtaaatgtgtttaaatagcaaaatgtatttatgcatgcatgtatttattttagtttcctgagacctctagttccttactagaaacatgtatataattccaggcatttaaaattgccatgatggtcatgttttcttgtccttttcccttattctgcaactgacatttgcccttgtctccaatttctcactgctttattctttgttcttgtaagtgttcttgtctctctgggctgacctctctccttccctggagtttgaccccgccccaccctttcttctgcatttgtttgcactggttgttttcttcattgcctttcccactgccccgctgcgctgcatgtgaaacactccgccagtagctgctcacagttcccatgctacatcatacccagcattcaaagagctgctgttctcacatggccgccagtaagattcccgactcctccttcacagcacattcctctagaaagtagaaagaatcccctttcaggccacatgagaagctgcgtgttaaagccaactccataaaggggaatggaaactagcgtatgaaattcagaaatgctacttttaaaggtaaataccacaaagtgaatttcaaattcatacagtttatcataatacttctttatttttataaatgctataatgtccttaatataatgatcactgtgatataagttgtcctctcccttaatatattaattaatttactaaaggagacgggagggtggaaatataataaattagaagatgattcttatatcagaagtacagcctttatacatagttttactttattcagacaatcaatgtagtcatatggtataaatttgaaaataattttagtgagcattacgcttactgagattaatagtgagaacttacctagcacttactgtatgccattcacaattataagcacttttgcatgtgctaatgcttttaagcctcacgtaacccagtgagggaggtacaattttaacctcattttacaggttagaaaaatgaggagcccaagggttaagtgacttgcctgtggtcatatatcaggtaagtgagagagccaggatttgaacccagacagtctgcctggggaatctgtcagaactcctaactatgcagtaccactcctctgataaaaagttgaattgacatgacaacatttcctattcatttatgattcgaccctttaaacaaaaagaacagcatcattctcacatttattaatttgtcaggaatcacctggatcatgagttgaggaaatttaaagtaggagggttgtatgaatttcagaccacgatctcaagaattgcctgtttaactcagagcctgaatcattcacagactaaaaactagaatcactcttctgtaggaccaagagggttgaatcatcaaagtcttgctgaagtgaacggaaatcctcctttgttcaatcattcattcaataattatttttttctggtgtctactctttaccaaactctgtttgagatgatagggattcagtcatagacagaccttctctgccctcatggaggttatggtttcttgggatgacagacagtaattttttaaatctcataaaataattacaaatgtgtcaggaaagaaaatacaggacactaccagaatatatagtaaggacctaaatgtgtgtgtgtgtgtgtgtgtgtgtgtgtgtgtgtgtgtgtgtgtgtgtgtgtgtgcgcgcgcgctgcagtaagggtgagaggcaggaaagggcaatcaggacaccctcccaataaaagtgacctttgaccgagatctgaaggatgaagacaagctgagtgactcttctattcatctatatcttttgttttaaatggcctgaagcctgggactaactaaacagggttgtaaaattccagtatgtaaattgaataactagggatcatttgaagtaatggactgcagagttaatgtataattaagtcacatctagggaagatttcccatcattatcacagagagcatcctgtttgctttcttcacagcacttacgaaaatctatagctatgtgtttggtggcttgtttaatgaaagtctgtttcccctatctgaatgtgagctccataaggacagaggccctgaataccacatctactgacatttggcagtgtctttcatatagtaagcattctataaatgtcttgaatagatgaatgcataaaactaagttaaaatgttactgaaaactataaaaataagcagaaagttataccagaggagaaaaattaggggaaaaaaactataatttctgaagacgtagtacttacatctaaatttgtggcttcataaggttaaccaacacttaaatagttttgccaaaactccaagaaaaaaatgaccgggtgtcgtggctcacgcctgtgatcccagcactttgggaggtcgaggtgggtggatcacctgaggttaggagttcgagaccagcctggccaacatggtgaaaccctatctctactaaaaatacaaaaaaattagccgggcatggtggcagacacctgtaatcccagttactcggaaggctgaggcaggagaaccacttgaacataggaggcggaggttgcagtgagccgagatcatgccactgcactccagcctgggcaacagagcaagactctgtctcaaaaaaaaaaaaaagaaagaaagaaaaaaaagaactaccatttgacccagcacttccattacttggtatgtacccaaagaaatataaatttttctaccaaaaagacgtgcgctcatatgttcattgcagcactattcacaatagcaaagacataaagtcaacctaggtgcccatcaatggtggattggataaagaaaacgtggcatatatgcaccatggaatactacacagctatgaaaaagaaggaaatcatgtcctctgtagcaacatggttggaactggaggtcattatcctaagcgaattaaagcagaaacagaaaaccaaataatgcatgtgctcacttataagcaggagctaacctttgggtacacatggatgtaaagttgggaacaacaggcactagtgacaagggcaggagggtgtgggacaagggctgaaaaaactacctatcgagtactatactcactacctgggtgacaggttcaactgtactccaaacctcagtgtcacacaatatacccatgtaataaacctgcacatgtaccccttgagtctaaaataaaaattgaaatctaaaaatataaaatatcaaatcataaaaataaataagaaaacaattgaatctactgatatgtttcattgcttttaaaatatccactttgaattactgaatattttaatatttttagttttacacttcagcacagaaagtccagaaatccaacccttgagtttacaaagacaccacatgatagttcatagttcacacagctagttagttgtggaactagaacccaaaatttgctctctatgtctctcacataccttttccctttattctaataaaggcatttgtcagtctaaatgtacaatattcgaagacattttttaaaggaactacttatccaaatcccacctgtcttacaaggtccatgtgaagcaatgagataaggtctgtgaaactgcttccgaaactatcaaatgttataaaaatgttaagttttattattagaactgcagttcatctctatgaaacctttctaaactttctcacttttctgaacttgactacgcagcgtcttttctaatctatttgttctccctttataagaagaatttaatcctttccgccctgctgggttgtaagaaaaaggactctcttcttttctataatctattgatatttgattatattacacatctaatgggttcccaataaatacatagtgaatagaattgaaccaaatttctttctagacatgtgaaaaaaaatcctgatctttaaatagaaagggtactttcaaagattatatatagaacctcttggtattttgtatttgcaatgaaaatattttaatttgggccaggtgcggtggctcacacctgtggtcccagcactctgggaggccgaggtgagcagatcatgaggtcaggcgttcgagaccagcctgaccaacatggtaaaaccccgtctcaatcaaaaatacaaaaattagccaggcatggtgacgcatgcctgtaatcccaactactcaggaggctgaggcaggagaatcacttgaacccgggaggtggaggttgcagtgagctgagatcatgccactgcactccagcctgggtagagagggagactccatctaaaaaagaaagaaagagagagagagaaagaaaagaaaagaaagaaaatattttaatttgtcttatgttcaacagttgcatcatatctgcatccttttgttaaaattgaacaggcttctagtttcatataataatttctggccaggcgcagtggctcacgcctgtaatcccagcactttgggaggccgaggcgggtggatcacctgaggtccggagttcgagaccagcctgaccaacatggagaaaccccatctctactaaaaatacaaaattagctgggcgtggtggcacatgcctgtaatctcagctactcgggaggctgaggcaggagaatggcttgaacccaggaggcggaggttgctgtgagccaagatcacgccattgcactccagccggggcaacaagagcgaaactccgtctcaaaataataataatcataatcatcatcatcataataataatttctaccaacagctggcaggaaaaaaatatgagagcatagtcatgaacttcagattccactccccttacttttggcattccattcctctgaattatagcttatatttctttattatctcagtttgatttagtctttctaaatattcacctctgtttccatccataaatatcgactgaactaccttttaatatactatctttttgtaacagagaaaatcaagtgtaggtggattattgtaagtgacactgaggaaatataaaaagaccttgacttgtccaggcgcggtggctcacgcctgtaatcccaccactttgggaggccgaggcgggtgaattacgagatcaggagatcaagaccatcctgaccaaatggtgaaatcctgtctctactgaaatacaaaacattagccgggcatggtggcaggcgcctgtagtcccagctacttgggaggctgaggctggagaatggcatgaacctgggaggcggagcttgcagtgagctgagatcatgccactgcactccagactggtgacagagtgagactccctctcaaaaaaaaaaaaaaaaaaaaaaaaaaaagaccttaacttgcttcaaacaagtcaggacccccaattccaattcttaggtctggcattcccatcagacacttaaactgtaggggcagtaaagttgcccatgtggctacagcttttgtggctgtgctgtacttgggaattttaatgttaccctctttgaattaggtccttcattgatcatgcatctcaaagtatctcagtgccacataaaaattttctttcagagtcatattttcccattatgaatgctacctactgcttatctgttgagtgtacacttttaaaccttctgtgggtggtggcccctttgccactgggtgagttagatgctgatcctggtcattatcgctgcctttccagccttttctgctcttacaccaagcacaagaattctctgctgatagtcaggatctagggctgggaaaatgggatgagttgtcctgttagacaggcccaaaaggagtattgtttaatccccagggtgtggggaagaaagatactcttgttttcttttccccaaatgtgtccatatacacccttctcctttgctggcagccaccaggcttgttgaggatctaccctcctctgcatatcatgtgcatcaagggaagccccaacccaagggaatacataatgatagtcctgagctatttcatggtgctctcgcagtcttgattgccctcttcggaattggacatggtcatattacgcaattttaggtaataaaatacaaagggcattcagctaagggaccttctgagaaaggtttttctcgtctagagaactaaacaggcatccttctccgggcactatgcgtagttctttattctacctggaacattctttctccagaaatctttgtgactaactctgtcatttccttcaagtcttattcaaatctcaacttaaaaaaaaaaaaaaccttcttaaaatttgaccacactaattagacagcaactgccccatctccctcttcccagccatctgaatccatttcccacttacctttttatgatagctcttctaggaaggcactccctcctccctgtgaatcatgtctccaggcaattgttccttgtgtagaggaacacaccaaatctgggctgctcctgtacaacaaactgaaggaggtagaattgattctgcaagaagttcaaagctaaataagaaggagtcttgtagcttctgtcttggtcttctggaatgctcactctggggaaagtgatctgccctgtactaagtctactctaaggccactgtgctgtctacatgaagaagccacaaatctaagctagccacatggggaagctgcatggaaagacaaatacgtggctagcccccagctgttggccgaagatccgcagccatcccaagtgaggagccagatgtacaagtgaaaaaactgtaacagccattccaatggagccttcagatcaattcagctttggctactatctgactgcaaacacatgaaagaacccaagcaagaaacacccacctgagcacagtcaactcacagaaccatgagcaatactgataaatggttatttttagccagtaagttctagggtgatatatagcaaaaggaacatctgtcctgttttttctggtttttcctatcatacactcattctgcaggattaacatgtgtaatatactttttttttttttttgagatggagtctcaatctgtcgcccaggctggagtgcagtggcatgatctcagctcactgcaacctccgcctgctgggttcaagtaattctcctgcctcagcctcccgagtagctgggactacaggcatccaccaccacgcccagctagtttttttttatttttagtagagacggggtttcaccatgctggccaggctggtctcgaactcctgacctcgtgatctgcccgccttggcctcccaagtgctgggattacaggcatgagccaccactcccggcctaatatacttttttaaattgtctttcactatgagaaggtgagctccatgaggccagggatattgtctgttttgttagctaatgtatccaaattacctaagaatagatcttagcgtggtaaatatttgttgaatgaacgagtgaatagatcagaatttcagtagctacgttgtgagtatgtggacagttcaccaagaatggcagaatggaaggatgggaggaacctggaataatgtcattgtgcttctggattacccagtcctggagcagctttgcctctgtgggccttgactagtcaagacattttgtgttgggtttttatgttaattccatttgcatcactataaaggaatacctgaggctgggtaatttataaggaaaagagatttcattggctcatggttctgcaggctgtacaggaagtgtggtgacagcctctgcttctggtgagggcttcagcaagcttacaatcatggtggaaggtgaaaggagaaccagcgtgtcacatggtgagagatggagtgagggggtgggaggtgccacactcttttaaacagtcagatcccacatgaactcactctgagtgagaactcacttattactgcaagaatggcactgagccattcgtgagggatccagccccatgatccagtctcccccaccgggccccacatccaacactggggattacatttcagcatgagatttgaagggaacaaacatccaacccatatcagttttctacaacctgcagcagaaagcatctcatctggcacatggtcttgcaaataattctgacttagatgcatgggactcagatatgactgaaccagaagataaatctaagtagcagacaccacagtattctcaaaaccactctttctctttctcttgttgaccgaggcttttctactgagcaaagcacctggtttataatatgttctttcattacgccttctcctaagagacctccttagtgtccctgcaatggatgtctggggagccaccaatctcttagagatgactagacatgtagccccagaaatggttacaccttgagcttttctctcagtgcagatgagatacattgcccatcccaccaatttgccacatttatctaaatttctgtgttaagctgggacctctaccactcaagctgggatgcccctcaccaccaccacactgcaaaaactaaacatttttcattagcctcctacttgcaattaagtacataaaacctgcaaaacaagtaataaaattaaggcactatttggttaatgccttttctcagaaatcacttttgcatgaagttcagttcagtattttatcagtgactacattagtctcgagaccctctacccaataggagggacaaagatgtacatgacacaggctcccttcaaagatgattaatacatgaactacatacagtattacaagggctccactagagatgtgagccccccagaaatgatattaatgtgcagaagagttagcaataaattttgcacaaggggtgacatttgagcttagactcgagcaatgagtagggttccaagaggtaaagaaaaaaatggaatggttttctaggaagaaaaccaggtctgggaagatctgatataacctgaggtagtttataagtctggaatgactgagttatcgggtatatggtggggaaggcagcagaggtgaaataagtaatatctaagcaaatgaaaaacatgtaattaggggagatgaaatataattaaattatttaccttaattcctcttttgactctttacatttgtcattcataaggaaacaatttcactaagattgttttgacctttttaccttatttggccaagtaaacaagggacagaaagtttttaatgtaaaatattcattcaacctgaaagaacattgatgattccagaccatttaaagttaaatattttagagttctcaattatttctatttggatgagtagaaccttttttcagacttcaggaatatatgtttagtttttaacagactaattgttcctgctttcatgccagcctcatgggcatcagcaggttcaaggttagtaggtaggaatctgccccctaagaatgcagcctaagagttaaggaatgcatgattacccctgtaattacttgagaggggctctgaaattctggcagggttggtgaggccaccagataacactgatcaagaatgtacacgaggttaggaattcagactgtagctgaagtggggagttcgggtaaacaggctctgaatggaaaagatcaggaattcaaatagacagttaagtcaagaaaccaacatcttagaaatgtaaacctcactttaagtcaaaggctctccaagctaagacttcataatatatttgccaaggcaagagctagtatctgcttacctgagtggtcctggagctgcggccagttgaaacaggagattgcagatggaatgtcagttagaatactttcagaggccagtaacagatacctgactttaaagttcttaagtttgtctttcccaaggttttctggtcataagaatcaccaggggcacttgattaaattattaattcacaagccccttcactggagattctgatgcaatagacttgggaatatatttttttttaacacgaactccagtggaatcaggcaagaagtgaaaaccctatcgttaataatagacacattagaaataatagagacatttgataatctagcacagttcccaaactttagtatgcatcagaatcccctgggggcttgttaaactacaggctggcaggctgctcccagcgtttctgatgcagtaggtccagcgtggagtccgagattctacatttctagtaggttgccaagttatgctgctactcctgtggtcaggaactgcactttgagaaccactaatcaaaataaactgaagtccaaagaccatcagacctagagctggttaattcaacagattagctatatcaagacttgaggtcagcttctctgggattctcttgtctttttcctcatggtcccaagatggcttcccactgcgccaagcaacatatccgcagacaacaataaccaaggcaagaaggaataaggttcaaggataactgtattgtgtgcgtgtgtgtgtgtgtgtactcatgcctgtgtgtctgtgtttggaaaagcaaacgtttcccagaagctccccaacaaatttcttcttatgtgtcaactagaactggatctcactgaacctctttaagccaatcactggctatgagaaacaagcttactgtgattggcttagaccagattttaattttttcctcagagctgtgtcctttgttgcccaatatctgaacataattgagcttctttaccaaggaacaagaagtaaatagctgttagttaggcaaatagctgggtatgtccacaaatgggttctgaaacaagtgtgattataatgaggttcagaattgaaaatattagtacaaatgctagtaaataatgtatgatattggctttcttatcaccatttgcaacagaataacagtctcatgaagaatttggcacagccattgtagaaaaagtgccttttcagagctcacagtatgcatgtactcatcttgcttttattatacctgtatatggaattgcaagctgtcccttcaggtaatgaaatttagacaagttggaacctgtataacagcaaatcaatactgaaattataggcaaagcctgtacttgtgcagactaacacataggatagaaagactttgtgatcaaaattcaacaaatcccacatttataggtatccaacatagagagaaaactatatatagtggtgtgtctttttatgtgtttgcgtttttctccttattcattcctgaaagtgtattttcttttaacagactcacaactcagctacaccccatatgcccacagtcaacacagtggaaaactgagttgtttatttgagcctcaagtcatccaaatacttcgttaaacgttgtagtaaaaggtctcccctgaattcaaggaggatgccctaagttttctgcatccttttgatagaggaaagtattaactaatgtcagactatctgttgttttattttcctttacagcactagattttgttaaggacattgataattttgaaagagaagctaagctaaggtgacaaatatatcttctgttggtcaatatctaaaattatgtattatttcttttttgactacaccttacagtggttagtttgcactttacgtaaaaaactgatgtctaccatcttccatctttgtaagcaccatccagcctaatagttgttggtttgaataatgccacaagctttgtccagaaaccaaaaacctgatttccaaagactagtctatgtagctgagcccttcattccataatcattaaactatggttaggacacagtatccagtctcccctcaaccttgtccaatcacagtctatgcagagatcatgtaactcgattaaaatctagaaccatagagacatttcccttccctggggcaaatgggaattgcacatgggggaaaatggtgtggataagcaaaaaacggaagtttccaaagtgcaacagaatattgataattttagtacatttcaacatacagtgagtgtaatgacggcattttcctactgcttccttagttgtgaagattttgttttttcttctgggttcactgccgggaaaagagcagaaaatgttttagagcctctgccagcagagggggcatttaccatttgtgcataaggtctctggcactgtgccctggggttctcttttctatatgtttctaacagtcacacacagcagtgtgactgtttacagatactttaccgtcttctctgattgaagcagggactggtttgccagcaacttttggttgtttttgtttttttgaagaccatgcaactaacagatgtttgttgttggctccatatctacattctttgaaagctggagaatcaaattgctgacattcagacaacactaattcccatatccagggagcctaatttgccgtccctgagatcctgattcctggtgttcacgggtttaaaaaccatttcagtgacacaatataagaatgggcttgggagatgcagcgctgtctccactaaagataatcacattttataaacatctgcgtcattactggtatgattcatctctaagctgtatacagctgtgtttccagtttcaattaacaatcccttaattgcatatccatctcatgttactaatttagttaatttattcataattaagagtattctgttttctaccaaggtttgtcgagctcagaacattataaagaaaaatattttaaggcagcatctccgagggattttgtttcttataatcacatcacagtaaaatgtcattcatgcgcccaaaggaagatgaattgctaagggatttttttttccagtaaaataagaagctttgggaagctgcagtgtgttgtgtttttaaaccaagttaaatgcgatgcattttgttcttttctttctccttccctgacatcctctcaaaaaaattatcattttatttgtattattgcttaagtatcacagcaaatccagtcaccagtgcaaataaaactgtcattaccctgtcaggtaatggtgtctcttaaaatctaagctataaagtctgtacattttagaggacattaagatcaagaatttttaaattgcctaagtctaagcaagtggagtacacccttgtggaaaatggaaggcagatgaaaacatgatgccaggcagtgaattcattttagtttgatcttttctacaaaaatacatatatccgtgcagcaagagtcttgcctgtgttagtacatgtgtctgtgtgtcattcaaagcagcaataacaaaaaattaagaccatttctcactttgtttattgttcaagaactcccacctatagccttgacctgtgtttgagcttaaaaaaaaaaaaagtcttataactgcccagtggtttggagattttacacaatagaaataataagccatcttttgcctcacatgaattctactaaaatcaaaactccataggatactttccaaagtaactggtgaaaggaaaagtgtggtagtataggtatgcatattatccccatcactttatttctgagctcttctattttttaaaaattttaatttgtatcttaaaagggcaaaacataagaagaggtaggagtattctaaatttcagtgacaacaaattcatttattttacaatttaaccattgcccgtcaacatttacttaaaatttcagcatgggaggttttaaacacttctagagtcccatcttaccccatttccacgatgcttttcttctccatgtgttgctgcagtttaatattgtctgcgtgttttaatatgttaaacgagttaaacatagagtaggaagttaaaactgttagcagctatatgtttcccaagattgatgaaaattcaggtaacactccaacctgttaaagatacctgcaatctggccaggtgcggtggcccatgcctataatcccagcactttgagaggccaaggcaggcagatcacctgaggccaggagttcgagaccagcttggccaacatggtgaaaccccgtctctactaaaaatacaaaaaacatttagccgggtgtggtggcatgcacccatagtcccagctactcgggaggctgaggtgggagaattgcttgaacccggagcctgggtgacagagtaagactctgtctcaaaaagaaaaagaaaaaaaaaaatatatatatatatatgtgtgtgtgtttatatatatatatatgtgtgtgtatatatacatatatatatgtgtatatatatatgtgtatatatatatatatatgtgtgtgtgtatatatatatatatatatgtgtgtgtgtgtgtatatatatatatagaaagagagagagagagagagagagagagtaagcagggaggggttgaagccagaaaagactagaaattatctaggccaaaccctttaatttatagattaggaaatagtttctggttgacttagctgagacgttctcatttgttaaaagcaagatcagaaatcagacacaattcaacgctcttcactacaccttgtttttctctttgtggaaaacaagacgtatcctgttcaaaaatttatgctgtttatctgaaagcccaaaatgcctgtttacatcatattttccattttgcaatagcagctcattttggggattattttctgatgaaatctctaggtttagttgtacttgaatatctttttatctgtacacactggaatatgcatataataattgatagaaatgtggattttaaaagtagagatgatcattattattttatgatcctttaagttaataaaattcacctagaataaaataaacaagtttaactaaagttctcgcattttcccagaaatcgtagactagaaactagtcttatttgcttattttattccaaagcttattttacctctattattttgtggttctataaaatatttctgtgtattcctccaaagaacctcttggaaaagaaagtaaacatcacatctgaaaaatagctgggcattttttcattatctctgcaaggggaggggacgtgaaaggcaaccccatatagaaactcaactccctgctttttacaatgaatgaagtttttccactgcactgtcagaatggtaattcttgctaactactcacctatttcacaacattaacagagttccaggattcatgctttaatattgcataatggtccatgttttgaacatgaggagtggcagcggagattacactttgattccttggatttcatgtggcactggatgggagcaaggcactgattttaagttgagataaaaaggagaagtcagtcaatgcctgcagccagacaggactcttgtaatagctagggagtatgcctcatttggatatgcatgactgccgggcaaggacactgccatgaatcgctaatggcagcagttgtatgacataagagagatgtgtatcagcaactcacaagttgactttgttacatgttatgaacacattcctgtgggcactcattcatagaagtgagaaatgtggacaccacagtgtcccaggcctttgttaccttatggcctgggaatatcttgctttgctggaacatgaagccacgtctggttataagaagaagtttgatctgggagcaaaattgcctgttcacgcatgtctttctcacttctttaaaactaacttgctataagggtgattaaaaaaaacagatgtcaggtgagagttttgctttgcatcaacttcctacttgtagaggtaataacataaaccttgcctggcaatcattatttgtcatccagctgagggtgtttactcttgagaaagaagtaatggacaaaattgacttggattctggttctatgtttcccattaattgactctggacatatacatgcaatttaatccatcttactaaaaacatgaccaactcacaggatgtaaattctattctatagaaagggctttccctcagtagttagtcaagggacggttcctaactcctgtctttattgagcttattttccaaaataaatgtattattttctactttgttcacagagcaaggcagcataaagaaattaagcaacaaaacaatagtgtatttttacccaactttctagaaaacacccatttttcttaagttttgatatttttttgccaacaggcagtcaaaaagaagataaataaaactgggttaagttggtaatgacacaataaataaatgagatgaagaaagaggcaataaatatgagtggataccaacaagaaacatgttcaagccctgaaaaaataatgagaaaaggtagaactattaataatacatcccgctctcgtatcacaccttgctccccagatacatcctatctgtcctggcaccatgttgatgctgttgttctgtaagctatgccaatgaacatgttggatgacctactccagctctacctcaagatttccaaataagaaaaggacccagggatctccttgctgaggtctttatccatttactcaggtcacaagtactaattaagcagctcttatgtgcaaaatgttattgcttcaggtcagtttttcctatactgctgttctataagagaggaagaaggtccctgccctcagaaagccctagaatacagatctagagatgggttcaacatctttgttatgcaattatttcattccaattgtaatgagtacttagaaaggacaaaagcagagtgctgagagagtataacagagggacttgacctggtgtagtaggcctggaaagtttcctggggaagtggtattttagacaaacaacacacacatacacccatgaatgtatacgtgtggagaatgtattctaagtaactatgatgaatgtatttcttactgtaggtcatggtcaaagtttgaaaactattgttctaactagtattataattccagggatagtagaggtcatgtgacctgtttagcacatgcctgccttaacagtatctagtaggccaggcaatgtggctcacacctgtaatcccagcactttgggaggccaaggcaggtggatcacttgaggccaggagtctgagaccagcctggccaccacggtgaaaccgtgtctctgctaaaaatacaaaaattagccaggtgtggtggtggtgcctgtagtcccatctactggggaggctgaggcaggagaattgcttgaacccgggaggcggaagttgccgtgagctgagatcatgccactgcactccggcctgggccacagagtgagactctctggaaaaaaacaaaaaacaaaaaaaaagaatgtctagtaaataagtcagtgccaagcaactacctgataactgttaccaccttagtcatcaccgaaggcagaaggtcttgcattcattggaggagagttaccaatctaagacatttgcatgaaaatgtgcacagagccctcacctgataatcaaagcatgttccaacacttctctttggataaaataagagttacatctcaatgaaatcacttgtggatcaagttctcatcctttcgtaaataaagagaggggcagcaagaaatggaagtgagcacatataagtgtgggaacctgtactttcctaacctataaagcattggatgtagtttttgctattggtgcgcatggagtcatgtggccttggagcagttaggtaccttccctgatgataggggagaaggcaaagaaattgatgatacatctctctcattgtcattccctagtatattacacttaaatctaactgccctattttgtgattgccttactgctgtggcttgaatatttgtgtctccccaaaattcatatgtggaaacctaattccatatatgatggtattaggaggtaggccccttgggaggtgattagatcatgagggcagagcccacatgaatgagattagaacccttataaaagagacccagagagctgctttgccctttttgccatgagaacacaagaaggtgctatctatgaacaagaaagcaggccttcaccaaacactgaatctgccagcgccttgatatcagacttcctagccttcagaattgtgagaaaaaaactttggttgtctataagccacccagtttatgatattttgttatagcattccaacggactaaaacattcattttccagaaaatctactccatttataagccagcattcttttttttttttttttaattttctacagatctctgcagaaacatgcagagtaataatagggccaggcacggtggctcacgcctgtaatcccagcactttgggaggccacagtgggtggatcacctgaggtcaggagttcgagaccagcctggccaacatggtggaaccccgtctctactaaaaatacaaaaaattagccgggcatggtggtgggtacctataatcctagctactcaggaggctgaggcaggagaatcacttgaactcaggaggcagaggttgcagtgagccaagatcccaccattgcactctagcctggacaagaatagtgaaactgtctccaaaaaaaaaaaaaagaagtgataatatatttgctgtatatattagttatagatagttatattgcagtactatcagaagctatgccacatattatttacgtatttcttaagatatagaaaacatccctcccctgcagtcattagtacttttgcattcaaacttcaaatgaaacaggactttagaaattataggcttggtgccatcctggccaacatggtgaaactcgtctctactaaaaatacaaaaattagctgggcgtggtggtgcacacccgtagtcccagctactcgggaggctgaggcaggagaatcacttgaacctgggaggaggaggttgcagtgagccgagatcgcgccactgcactccagcctggcgacagagcgagactccgtctcaaaaaaaaaagaaaaaaaagaaaaaaagaaaagaaaaaagaaattataggcttggtgatttctcaggcattaactcaagaaagcagcctttataccgattacctacattcacccagcacttaccccattaatttctaatgttgcttggaacaaatgaacattcctggaatgcaagctaaatgaaagagccccgaagaagaacagggcatttcctggttcctcatattgacaaatttaaaagcctgtgctataatatgggctcctgtttcctttcaagtttgtctttgaataagtggacagagtagctgaaagcagagtatttaaagctttgaaacgaccactttatttcagtctctgttcttgctgggaccactcttataaatgaggagattagaaaatcacctagaactatttaatcgttgtgcagaagaccctcttaccccaaatatttacttaccgctcattttattggcacactgcctcaaattccacctgctgtgaactgacctaagtgaatttaggtcacgtgcaactattaggttctttttgggaaataatggagaaccacagatgtgtttgaggtggatgaggaatggctacctcaagccgcagcttcatgcttcatgctgaagtcctccacaagtgcaatcatgtcgttaaccaacatttgttagaaggcaggcagaagtcagcttacagcctgttctacaatttttatgaagtgtaggattttaggcttaaattgacaccattgcaaatacagtattctcttacctttagatttggcatcaggtcacaagaattcttcctaagccaatggttggatacaaggccattggagaccagacgtaaaattaaaagcccaagcaacaggttttgctggattcttatatcctgtttatgcaatgttaggggatgtcattaaaatattttagttaatccatgtatcttgattgtcttaaattttactaatgagatcctatagggatattcattgcaatccactatttccctcagcaaaaacacatttgcgatatctattacatgcattacaaaatcctccaaggttcacagagatatatagtagtagcagtctctgggttttggcctttttcataagatgaaggctgtgctgtcctagaatatgaattcctaattaaaataaccatttgcctcaagcctctagagttgaaggttgcactaactgcacatataaaatatccaactatctatgttgagatatttaaaattaattacagatattgtaacaccattatttaacttaaattccattacaggtcctttgagtatgcaaaatatttctttgagatgtggtaacccctttaactgatcaggaaataaacctttattatcaagttgttatcccaccttgacaggcctaaagcgcagaccacatatcagaatcccctgggcagcttataaagctcctcatgcccaggctgcatctcagaccaattcaatctctgggggtgggctccaagcatcagcatttgttgaaaatccccaggattacaaagtgcggtgaagtttgcaaacccttgtaataagagaatgggaggagggatggctgtttgccaagcagaaccaggaatgaggaaggatattggtaaacaaaatttatccataattgacttttcatgaatcacagtcctactgagacccagccttgtctcatgagactttggctacgatgatgagtgagaaaaggactcctcctaatttaccagactcttgattagaagcaaatgaaattttggaaaagagacaagtcactttcaaaagaccccagcctgtacctgaccctacctctggactccatagtaatggcaggtagtggtcattcctggagtaactctgtatttcttaaaggaacatttgcataatgaacctacagcaatctggaagacgactggggtaaatagagaatttgttgattttagatggctgaatactatccgtgcagagcaattaaaaggacaactgtcagaatcaagtaagagaaaggaaataagagaagtctcatgttagtagaccttgtttgatcaatgtgttttcatcttgtatatgattaataaaataagtttgggagttaggatcaacctttgtttactcactggagaataacttgcatatagaatgaagctgggattgtccaggctggtttttttccatttggaagtttggatacaatacaaggaagcctgaattccaaactgtttctcttaaagagtgcctttctgagccgctattaaggaatgcttattgtttcgaaaatggtagcacagaagtgttataactagagtacaccttgtgcctgcaattaattacccagtgtcttcaaaaattcttgtcttttgctggtagaaaacctttgaaactatagttgtctgtggtattcactgcagcaccttagatataaagagagaaatttattttcagaggaatcttgagacagtttgtgtgtgtgtgtgcatgcctgcttacacatctattggttttccccaaggattgtagaaatcccattaaaattccagcttcttaaggagctactgaaactccagtttttcatattttcttttataatatttggatgcgtttaggtaaacttgcagcattttaattatgtctgtatcagatgagcggaagaaatgtaaaagggtttggggagagatttaattttagatagcggcgtaattaatagcatttggaaaaactagtggaactttaattaaatgtctctacattaatttagtcatttaattgaacatgtagtgggatagtccttacaatttttcacccttactctttgaggaaaaatgatttttgaataacaaagcatcagtatgactactttttattatttagctgtatgttcactacttggcactttgtttaatttttccccccatatgtttcgagctttttaaaacattaatttggcttgtcgcttttatcttaaaaactataaatctgggggccgggtgcagtggctcatgcctgtaatcccagcactttgggaggccgaggtgggtagatcatttgatgtcaggagttcaagaccagcctgaccaacatgacgaaaccctgtctctactgaatacaaaaaaaactagccgggtgtggtggtgcatgcctgtaatcccagctacttgggaggctgaggcaggagaattgctggaacccagggggctaaggttgcagtgagcagatattgcaccactgcactccagcctgggcaacagagtgaaactccatctcaaaaaataataataaaataaagaaataaagaaaactataaatctgggagaaaccgtatttggaaacattgagcaactgtttcttttcctttattttagactttaatattcactagagtcatgttgtaaagttttcaccttaatattgtaggctttttttttttttttactttgccaacttaactggcttttttaaagtggtgttatgctgcagcagtgtatctgaatttcagcagtgccttttacgtggctgctcacaatcttattaaactacatgaattatacatggagagaaatataatttggtaaatttggtgatgtttcaataaccatgcccaaggaggaatgttgtgttaaactgtcaatttgagaagtgttttgtggtgctaaccacagagtgaattcagttctacttcatttcacaaccctccataaatagtgccccctaaaagtggtgcctccttgcctgtactttgacccagatttttgtcatttttctagataagcatatacattgtgcacttattaatttttcaaatgacacaaaggtgagaatgggagtcaacacactgaaagatcaaaatcaagactcaaaataagattataacagactgggatactgtaccaaaataaaaaaattaaaataaaatttaacaagaacaagcaagatgtcctgcctttaagatttttaaagtcttttgtacaaatataggctgaggaacatctgactttgtggcgctttatatgaaaaacaaattgggattttaaataaccacaaggactgtattaatctccagtatgatctggtgtggcttactgtacgaggcaatacagtattagattgcattaatgaaattcacaaatgttccattaatctcttcactagttaaaccacatctgcagtcatattgacttatgagcatcacgtatgatgagaacactgaaaaatcataatacattgacagcagggcaaccaagattgtgaaaggtatagcgatggttatatgacaaatatttgaaagaatctagaatgttcagtaagaagataacatgaaaatacaggacagcttcttcatgcatctggggagggtgggtaaaggacacagcacacttaattaagtaagattgtagaagagaactatgggcaagtgttacagtggagcttactctgagtaaggaaaatgtaaacgttagagttgttattaagtggcatgggctgcttcacaaatttccatcattttttaatctgattcatctgctaataggacaaactgtaacaatagcttaaacaatagagaaatgtaggtctctctcatgtacaagcccagaactaggtagatcaggcctccttccgctattctgcttcactaagtccgaagtcctcctttaccttgtcctgccatggtggcctcaattctcgttgtcaccacatggtccaatatgtctgcttcagctccagccaacacatctgagttccagcccccagcaacatggaagaaggaaggaggcacagagagggcgtgtgccagcagtgttgtgagaaaatctttcagaaactgtcatgaaatgtatcccctgatagttccttcaccagaactttgtcccatgattatatttacatctatgtgaggctaagaaatatattctttccttcaggcatctacatacccaactgaaaattatgagttctattgccacaagaaaaaatggaaaatatatggggacaatcaacagtacttgcacaaagatgttttacagagaattactcttttacctgggaattttacaagataaactttaagatcctatcaactctctctctctctttttttttttttttttttttgagacaagagtctcgctctgtcacccaggctggaatgtagtggtgcgatctcggctcactgtaacctccacctcccgggttcaagtgattcttctgcctcagcctcccgagtagctgggactgcaggcgcccgccaccatgcctggctaatttttgtatttttagtagagacggggtttcaccgtgttggccaggctggtctcgaactcctgacctcaggtgactcgcccgcctcgacctccctaagtgctgggattgggattacaggcatgagccaccacgcccagccagatcatctctggaggcagggggatcacttgaggtcaggagtttgaggccagtccggccaacatgacgaaaccctgtctctactaaaagtacaaaaattagctgggtgtggtggcaggcaactgtagtcccagctactcgggaggctgaggcaggagaatagcttgaacccaggaggccaaggttacagtgagccgagatcgtgccactgcactccagcctgggtgacagtgagactctaactcaaaaaacaaacaaaaagagtctatgatcctataatttatagacaacatacaacctcctttctctacaaagagaattggttctcaagggctgtttggaaattcatttccttttaagtccaaaatgacatacaaaagtgaccaatatatacaatgtacacccttctacaataagttctcttttgttgccgtagtaatcgcatgtcttttcttaaaggaacacttttttgactcttttgtacttttgaacatagcggtgttaataataatatttataaaacattatgaaaatatgcacacaaaacacaacacaggctaagaaaacctaatggtggcctaaagtaagttctgatgtcctctgttggtggtattcttcattgccatgcttctgctgtgcctgggacctttattgctacctatgggaagttgtaagtagagaagtttctttactacagggatgtgaacaatcattgtaagtaaggaataatgaattcacataagttcacagagcatgtttttctgccctggtaatactgcatttctcactttgcatttaaagtacctacgcccttacacagaaaaagttatcggggttgggtgcagtggctcacgcctgtaatcccaacactttgggaggccgaagcagggggatcacttgaggtcaggagttcgagaccagcctgggcaacatggtgacaccctgtctctactgaaaaaaaaaaaaaaaaaaaaaaacacacacacagaaaaattagccaggtatggcggtacatgcctgtagtcccagctacttgggaggctgatgtggaagaatcgcttgaacctgagaggtggaggttgcagtgagccgagatcgcaccacttcactccagcctgagtgacagagtgagattccatctcataaatatataaatatatatatataattatcgattgattaatattattatatggtccccattactctaaactctcaaaatgtaatgtaggtcaaaatcagaaaaaggccatactgtctactccttcctctgtttcattccaactataagagaaagggagagggcaaaacaaagatgacaggaggccaaattgtacatagaattcatggaaattcttacccaacatgtaaaattatgatagtataaggaaaagtatactgcaaaaattaaacttctacattgtgaaatggagaacatttttacatctagctctattgcttctccctgtggagctgttctaagcacaaagttcccattacataatgaacaactccttaaatactgtgcaactatttctcactagaagcacgatgcagcaaactctgtttctcagtaaccatttatatcatacctagtggtaccgagttctataataaaagggtgatatgtgcatattttgtggtcatagagtgcaaagttgacatctacagtttaaagcattgcattgcatgaataaggtcaaaatttaaatacttttctatgatcatgttctttacattaaaggttaaagatgcatgccgctttaaaaatggtttaagggccggacacggtgactcacgtctataatcctggcactttgggaggctgaggtgggcagatcacccgaggtcagacgttcaagaccagcctggccaacatggcaaaaccctgtctctactaaaaaatacaaaaattagtcaggcatggtggcgggcgcctgtaatcccagctactcgggaggctgaggcaggacaatctctggaacccggaaggcagaggttgcagtgagcagagatcgtgtcactgccctccagcctgggcgatagagcaagactctatctatctcaaaaaaataaatgaataaaataaaataaaaatggtttaagaacttcaaaccatctggcaccagaaaacacctaaattgaattaaaaatctggaaatttaatttcacaacttgtcctttttcaagcctaccctaagttttgtttacttaatggggagaatctgttttatttgttcctatgtagaagactgctgattttatcatgattgtattagggcccaaggatatttaaaatatttcagtagctattacttatactttatatctgcattgcactttagagttgactgagcattttcaaagtattatcttaccaaattgccacaatagtcttgagaggctagtaaatcatgggagaagcccccatttccccactggaaagcagagaaaacccccattgtagtaaaggaggggttccctccagagctcttgtggttgtgttgaggaggaagtattaatgctgctgggcatgacttacaagaaataagtcaattcacttaagcaaaagtgctatgatcctgtataccatgtgagcagctctaggatggggtcacccagcattttggagcagacattagaacatctggagggagtaaacgcaaagaaaatgggctagatacctttccttggatgggaaaggataacattaagataccaagatcaaatgttcaaagagcacatatacaccagagaatactatgcagccataaaaaatgatgaattcatgtcctttgtagggacatggatgaagctggaaaccatcattctcagcaaactatcacaaggaccaaaaaccaaacaccccatgttctcactcataggtgggaattgaacaatgagaacacatggacaaaggaaggggaacatcacacaccggggaatgttttggggttgggggagtggggagggatagcattaggagatatacgtaacgctaaatgatgagttaatgggtgcagcacaccagcatggcacatgtatacatatgtaacaaacctgcacgttgtgcacatgtaccctaaaactttaagtataataataataaaattttttgtaaaagcattgtataataaaagtagtaagataaaccagtaaaaacaaaacaaaacaaaacaaaacaaaaaaaagttcaaagaggccgggtgcagtggctcacgcctgtaatcccagcactttgggaggccgaggcaggcggatcacttgaagtcaggacttcgagaccagcctggccaacacggtgaaacctcgtttccactaaaaatacaaaaattagctggatatgatggtgcgtacctgtaatcccagctacactgaggcatgagaatcacttaaacctgggaggcagaggttgcagtgagctgagattgcaccactgcactctaatgtgggcaacaaagcaagactctgtctcaaattaaaaaaaaaaaaagtttaaagaaaaataagttatttctccatgcttcaggagatatgtttcgcaggagaaagaggcttaatagagaaaacagatccctacaaacatttgtggtttttaaaactgccccattggttactaagtggataacatgagcgtgatgccagattcagtactctagtgagccatgcagctttgctgtgctctgcacctgatgagtgtggcctcacttcttataaatgcctgtcattgctaacaggggtccttgctgaaacaacagggctggactaatgctctagttcccttcctggaaaacctatcccaaagctgagatcctcatgatgccttctctcatatatgaatgattgcaggttacgctatcatcattaaatcgaaacattttagaccactttgcgtttgtttgtttgtttgtctcattatgtccagttttatcctgtttcataatttaataaatttttattgggtctgtcttctggttaaatgttgtgtgtataaaaaataaagtcaagagagagaacaggagttatggaactaatgacaaatccatccttcagctaaataaaattatactatggatgatttgagctgtacgttgagtgataatttttaaaaataagatagatcgggtgcggtggctcatgcctaaaatcccagcactttgagaggccgaggcggatggatcacgaggtcaggagttcgagaccatcctggctaacatggtgaaaccccatctctacttaaaaaaaaaaaaatacaaaaaattagccaggcgtggtggtgggtgcctgtagtcccagctactcgggaggctgaggcaggagaatggcgtgaacccgggaggtgaagctcgcagtgagccaagattgcaccactgcactccagcctgggcaacagagccagactctgtctcaaaaaaaaaaagaaaaaaaaaaagggccaagcatgctggctcacacctgtaatcccagcactttgagaggccgaggtgggtggatcacctgaggtcaggaattcgagaccagcctggccaacatagtgaaaccctgtctctactaaaaatacaaaaaattagctggacgtggtgacaggcacctgtaatcacagctactacggaggctgaggcaggagaattgcttgaacccaggaggcagaggttgcagtgagccgagattgtgccattgcactccagcctgggcaacaagaacgaaactctgtctcaaataaaatgaaataaaataataataaaaaataagataaagtatcacaagtaagatgtagttgaaacttcatgcatttttctatgatgcctatgatattcaaaagataactgaatttcatgagcagagttcaagaacttctgagtatacttttcattgatgacttaatgtaatggatttctatgatgatggcactatattcttttggtgtttatggtattaataaaaaattgtggtaaagcttgtggaaatgaacatgccttggattagggtgccttaaatgtgcctttgtaaatgcagctaggagactccaagtcacccttctagtctaactgctactcctttcttttacaaactacatgccaactaaactgaccttgatctgtttatgaaaaggcggtataggaacaggggctctgcaattggacagatccaattctaatcaatccactccattgatagatatataaccttgagtccttcctgtgcctcagtttcctcatctgtaaaatggaattaaaaaccaacttcgtgaggcttttggagaatgaaaatgacataactcaaagattattgggtatcagaaacaataatgttatctatcactgtctttactgttattattattattgtcattattattattttctctacctggaacaccaattccacaaactcttaatgtcaagaccatgctgtatcatggagccttccctgattcctccatatgaaaataattaattctcatattaataatattacttttctagttgtattttctttttttagcttttattttaggtttgacggtacatgtgaaggtttgttacataggtaaacacatgtcatggaggtttgttgtacacattattttatcacccagatattaagcccagtactcaatagttatcttttctgcctactcgtattttcattatccccaagtatactatacatatcttaaaattaggatccatgttgaaaaaacattgatatttcctatggcttctaacacagtacattgcacttagatattcagcaactctgtattgaatgtatgggtacaatctgctcttagtttctaatttggtattaatatgttcaagcctcaagagctcatgtaaatgatggtttgactatattgcccatcttttgttaagttgaaaagctgaaattcatgcactgtttgttagtgtagtaatttgtgacaacgtctagctattaagtcttttctaggtataaaacctttatatctgtcattgttcccctcttgtgtttttgctttaatatcgttgaaagcatctattattggaactttcacttctgaatagtacttttgagaacctgtatagaatttcagaggccttagaaaattgtcatagattgcttttagtatatggtttaccactgtggtctcttaacttttcaaaaagtatttccaaagggcacttacatccataagtggaaattgatttacatctattattgctgattgttcactattctgaacttcggctaaacaggtgatttaggcagaatttttttaaatattagattttttcctactttctaaatattttgtagctctttcttattaatttgagtcaacttatgctcgcttttttttgtcaattatagatggttgtcaggggtttggcaaatgtcatatgaaggtaattctttaaaagttgggatttttgaactgtttatttctactacttttgattttgctggaaattatcattctattaaagggacaaaagggtgctcagaaatatgcattgaaaaatttcttacagatttatcaaccattgccctcaggcactgatattcagccagtatgttccaatacatccatgtctttccattttaaaccttttaattctgttctaatttttcattgcctgtgcctgattgttctgtatccatctgatacgaatggttaagtacaacattttaaatatcactcttgcctatacatattatttttcttgtcagatgatataattgtagtcattacatgtttcttaagcacaactgaaatcttaatttaaatcaataagtcttgtttctgtggccattgtttcccagaactctccggatttctaagcatggtggttattcttccaggaatagtgccgagagtcttcagcagcatgcatttctctctaattgacattatttcacactctccattttccttactattgaaaactgtatttcattggtattttgccaaggatcctgctctgtttcataataatgttctgttcgcactctctgcactgacaaatacctattccatgcatcaattgcataaatggcaatttgaaagcatttaaccacagctggatatttttcattgattcttttcatctgaagatcattcattaggcttctccctcctgtttcttctcacatccatacctcctttcctcctatgtacatagtgtcttttgcattttctgtatttaagtgtaaattgctgactacagttatgcttttacctcattccatggtcataatgaaatcacaaatttaaaaatgtactactttttaaacctgttttctgacttgtccatctaaatgcaattttataattcttcgacattcagcctcctggtgaatgatttctgcaatctctccaagacatctgtgcagtgttatggattatattgattgcattttgtccatgttcaaatttgcagaatgtaacctacagaatatatattgactaataaagaaatgcatccacatggtggatggttgtaaagagaaaatatatattggtgtgcagcaggcgcccacacaaatgaaatctagaaaacagcagcttgccatgtcagagttgcaaatgaaggctgtggctacaaaacacagaaagtctggagtgtatgaaaggtttttcttccaaattcattcacacataaaaatgaaaaaattgaaaaatcatatatgtgcaccttaatttttatatcgcattggtgtttgggcatacgaccctgagattttcataccctcgatttttttaatataaccacctgagcgtttcttcccatggggttactttagaagatggggggtgtacacactacgtatgtatgtcaataaagaaatgaaggaataaaggaggaaagaagtgaagaaggctgggggtaggaagggagggagaaattcagtgattcattacttattcatcatcctaaactggcatataaaataatatgtttaaatcagtctaaaattttcattgtataatctctgaaataactagtccccactccctaaactgtttggtgtaaatatttatctatgtctaatcatttctatgcaaaatagccttatatatattttcattttcataagatcatctaagaatcaaaggaaaagctattttaggcaatgaacataggcagtgatttcaaaatagaatttgagaaatgcaaggatagatggaatcacaaaagatgatctcattcatggtgttttaaaccctacaaatagatttctgtttagttgacctcatttcaatagcttctcatttttttcagaagtgtatttgatgtgtatatttctaataaacttatttttctttttgtacccagtattaaggagcacagcatttatatccactgaacaaaggataactgaaaggaaactccttgatatccaacttggagtatttgtttctcgaatgaatatgagtttatataagtagtttttttcacatacataaaattagaatttgtttgtattattgatattatttcagaacagcggatttaacgtcatagatgatctagatgtgtcctttccttagaaatctttaaaatgaatcacatagtctagaaacagatccagatactacatgctctcatcagaaaggactttcttctcttcgtgtcaagttcagtgttggcaccgtatagacaaagcgtgttaaaatagcagggttcttgttctctgacacattacaagagaggcaagattataaaactgctatgtgtctcattataattcccattagtttcatttgcttcaaaacattcacttctgtgctttttgcaaaagctttcaaacttattttttgatgattctaaaagtaattcttctatgtcttttcctagtgatactagcattagttttcttttccaattgtactaggaggcatgagagattatcgatgccctattttcttgtctaaataggcaacccaaataatcatagtgacctgttcatttatattatctttatttcttgcctcatacttcttcatatttcttcatttcccatgtttccttattctttggagccagaaacgatcacgttaatcactctttccattagttttctcctatacattttctgatctttctctgagccagttaagagtcattcagccatttgataatggacactagtttactttgaccttgcaaacacaaataccctgtttgatctttatttgctgagagcagtaagacagaagaattacaataaactttttagcacccttctgttcaattctttttcagaaatcgttccctcaaaaagcctattctaggctctttcttttggcagtttcctagaattttcctttgcttttcaccaactggaacattatcactagaagtaaactaagggaccatctaattcaacaccctcgttttgtactttaggatactgaagccaagagaagctaatttttttgcctgccataacacaactagttagtgaagcagccaaaactataagggatcttgccaccataagctttatcggcccatccgtttatctcctcaaagcagccctatacctgatttccttatttctgttctctaagtaagccaagctcagaccttagagtgaccttcccctaatccaccctgcctgacatccaataaactgacaaatccagttgattatgaagctacagtgtttttcaaaccataccataattgtctaggctgttgccatgctctacacaccagttttcttattccagtccctccctgccccagtcccagttcactctactcagcctctctactgcaatggataaaatcacagtttccagattcacaaagctcacagctctgccactttctagccttgtatttgtgtttcagttgctgctgaaactctctaagcctattttccatctataaaatggaaaccaacccagaggctcgttgtattacagagatattgcatgaaaagcatttagcgcagtgtctggcccataagaagtcctcagtaaatagtagtcttggggaagcagtagggtgttgtagtaagagagcagagcaggggacagcaaactacaggtctcagtacaaattcaacatggggcctgggttttttttaatagcaggggagctaaaaacagtttacttgttttaataagttgtacgaaacccaaagaagaatatgtaacggagatttatgtgttcctcaaagccagaaatatttactttctggccctttacagagaactttcattaattcctgttgacagctgtcagggtatgaatcctctctaccacttagaaactgtgtaaccttgggcaaatgttttaacctctccaaggtttggtttccctgactgtgaatagtacctatgttacagggttgttatgagaattaaatgagatcatttatatcaggtgcttagctcactagctgaaataggatttaataaatgttagctgacatggttacgtctactcattgttgcagataaatagcctctaagtgcagctttaatagtgattgtttcttaaaatttttgaacaaagtttttctatttcttatccaattaaataaatattccacattctggcattcaatatttctaacgacatcaagcaactctaaaatcattgaatgttttaaagcaacaggaaaccttagaaataactcatctaaactcatatcatagatatggaaactaagggccaataaaaccaaggcttctaggacctgaaatcagatcctctctttttaggtagtgtgatcttcatcgtgcttctgccatgcaatctcagaatttaaagggatttaagaatcattcattttcttcctaaggcaggattcgaccctataaaatccctgtcagtttggtcattcaaacccagtttgagtacagtcattgatgataaatcacccttttcccagggagcagttctggttgtttcaaagtctttataataaatgaaaattggctttcctgaaatctctatatattgatctattcctgcccactggagccaaagagaaacgtcacttctctacatctgtaaaatactcgttgtcaattttcgtatcttctctaagcatcctcgtttcaagctgatgtgaactagttgggtttttgattgttttcattgtcctgctaagtcgaaaagctaagaaaagcttggctctttcatcactgttatatatcccactgtgtaacagaacttgagttcagggtatacactctaaataactgcttttgtaaaagtattcaattatattgatttttttcgttccctctgttgttcctcataattaccctcagtcaagactttcatcttcgtctttatcttcctctgcaagaattaacagtggtcccttttgtgaacttcaaatatctgagactggtctcagttaatttaggaagtttattttgccaaggttgagaatatgcacccatgaaacagcctcaggaggttctaacgacatgtgcccaaggtgtttggggcacagcttggttttatatatatttagggagacatgagacatcaaccaatatatgtaagatgtacatttgttccatccagaagggtgggacaacttgaagcaaggaggggcttccaggtcacaggtaggtgagagataaatggttgcattcttttgagtatctgattcgcctttccaaaggaggcaatcagataagcatctatctcagtgagcagagggatgactttgaatagaatgggagacaggtttgccctaagcagttcccagcttgacttttccctttagtttggtgattttgaggccccaagatttattttcctttcacactttcaatataagctatccagaactgatgataatattccagatatggcccaaccaatggaaatgattgtgtttcctacataccatatcacaatcaaacctgttttgcaccttgcatttactttctttattaatgatgtcattgcaatttagaaaatttggggccacatttacttcttcctctctattatcttcagtttttatttggtcactaaattctgtttgctgactcttatatctaaaaataaaaacactcaaatccagctattcctctctaactactctgcccttccctcagtcctttctcagtgactattaatgatttggccttctaatgattagcctccctgtccccagacttttatccatctttatcactatggctagttatcttgctaaacaacagatctaatcctagtaccccattatattaaaaaaatcttctatagctacagctttctctccctccaggtcagtatccatagcctgtcaagatgtggctttgataaaggacagaaggcagggaaattctgggcagaagagggcaggtccccattgaggacccaccctcaagccaaaaagcctggaaccatggcccaaagtgagaacttacatccctgttttccctcttgaagggtgccttttccaaaaccatccattaccccccacccaccccccaacctgtgcctataaaaaccccagagctcagctggcagaaggaggagaagcagatggatgtcagaaactacagttggacatcaaagagaagcggcttgactttagagggacagtttgacagcatagctttggagaggagtccagctgtggatggtcagactccaggggaagattaccttcccactccatccccttttcagctccccttcccactgagagccactttcattggcaataaaatcccccatatttaccatcttcaatttgttcatgtgacctcattcctcctggatgctggacaagaacttgggtgccatgcgtgtgggtgaaaaaggctgtcacactgaccctccactgagctgttaacacttaagccatctgtgaatggcaaagctaaaagggcgctgtaacacttcctcatgggcaccctcccctagaggctgctgcagggcccgtacggtgttcactcttgccagcactcaaaaatgctggccccagctgctgcacctgctcacctgtgctcccccttccatgaggggtggaccagcgagtgagtggagtttgctcccctccagttcccacccacgaagggatcagggaaatatcctccttcagctccagtgaggcacagtggtatacacctatagtcccaactactgaagaggctgaggtgggaggatctcttgaacccagaagtttgaggctgtaggcactgtggttgtacctgtgaatagccactgccctccagccttggcaacatagcaagatctcatctctaaaaaagaaaaaatatatatgatgtggctccaattcactgatctagcctcttaactgaattccttcctcctggctgggcacagtggcttatgcctgtaatcctagcactttgagaggccaagacaggagaattgcttgagcccaggagttcaagaccagcctgggaaacatagtgagacttcatatctacaacacattttttcaaaaagaattttttcctccctgctccccaccctacccccttgcaaccttatttactcttcggcctctggccctctcgctatgtctttctcagcttcatgcctttgaaaatactctttctatgcctggaaagcccttataaacctggaaattcctattcttattcaactctgagccagtccattttagtggcttagttcagaggctctagatttaaattgcaattctgtcagattctgtctgctttgccaacctcaatcaagttatgtactatgcctcagtttcctcatcagtagaatgaaaataatacagtagtgcttttttcatagggttgtagtgaggattaaatgagatgaagcgtataatcctcatgtacataacacagtacatactatatgtgttgcacatagtaagtgctcagttctttttctttgcattattcttagcacataagtcaagttacatttgctctcccttacgcaaggtcaattgttcttttttatgtgtttacccgttactttgttcatgcatttgttataaccactgccatcataaagcaacttgctatctttgttcataaaacaaatcccagattcactgagctcaaagtgagagaaggaaactttgcattatgtgcagttcctatgcttttctccaaatttcacatctccgttggggatctctcactagttatccttgccatacccccacaccagccttacaattttgcattatgtttcctacatcatgattctaaacggtcctcctgttcgctttctctccatcccatatcgttgcagatagctatttcctctttttaagacagaaacacatttgcattttgcctaagctacatttgtaaattttacagtattttcgaaagacacaatggaatctaggaaagatgcaacagataaagagattaactggccaatttttgagagcaccatccgtaaagtccacgaacaagtgaggcttccttgtcggagaaagcaattcagtcaccataaatgatcattcaagcctgatctcattccctcttgaaactggaaattgaaagcttgttcctctgacagttgtgttgtcagtggatatgcccagtgtgcaaaggactggacaaagggcaaaagtacacatatcccatctggaattctgagtcatccctgagacatcattttggatttgtctactgagatgaaattaaaacatgagtaatcaagcccacacttcttccccctcaaactcatctctttggtatcatcaagaaaatcaaatgctaatagccattgacctcctaattctagtgctcttagctatgataaaacagtcattaacttaatctaaatgttgcaaataaaggagccccatcaaagctgaagccccaaaattatacaaatgagttaactgggaaggcatgggggaaacaacagttttcataagacacactctaaatctagtttattctcttaggaagacttttctcatcaatagagagccacataaagatgccttacctgcctttcacggggactatatcaattggctgtactgtcactcactccaaaactctcaaaatgcctaacacagattcttgattttattgattgcattagatgttacgttttctaaattttcagcaccctggaggtcacctcaggaaatcatgcagtttttgaatgattttccttagaaatacacgtgtagctatacatatgcccatgcgttatttaatcagttagtgaaaggaggaaaacagcatttctattattgacctttctcaatctctgaggagactgtatgtcttgcctacagtccaggattgaaagcaaaagaaaaaggcactgacaaaatagcattttattttaatagcacattatggagagacaaaaaaaaaaaaaaaaaaaaaaaaaccctgggatttcctttgtctaagtagaattgacgtatgggtgagatcagtctctattttactcagtacaagtgcacacatatttatgtacacacatataattgtcatctttgggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgtggttgcgggcgcctgtagtcccagctactcaggaggctgaggcaggagaatggcgtgaacccgggaggcggagcttgcagtgagccgagatcgcgccactgcactccagcctgggccacagagcgagactccgtctcaaaaaaaaaaaaaaaaaattgtcatctttggaagctaagggccctgtatcagagtatcagaatatacctatatccaggatgcaatgttctccagttttgcattaacatcagctacaaggttcactgccatctaagactaatcaacagtaatagctaaaggacaaaggtcagttcctgagagatatgcctaaattcatctggctatatcttctgttcctcccaaaccctaaccccataaattcttcattgtttagaaggattcatattttttgtttgtttttcatattcccattttattggctggggttagaattgcaatggcagcaaaaaacacagaagctatctacagtggcttaaataaatagagttttatttatctccaatattaagatgtctggaaataaggtgctttgggcccaacagtatcaggactggcatctgtatattttttattgacttttcctcatgcaatatagcagccaccattatttcacagggtgaaaaagagaaggcaaaaagggtgtactatctgagtcttatcatttttataaagccaaaaatttcccagaaaccttttttgaaagacttctacttgtatatcattgtgtagaactgtgtcacatgacagccaccaacaaaaagatggctagggagaagtggttttcaacaggtattgaagtagctaaccggcagtgtctgccggtcttcagttataaacaccagcagctaactctggctaattcaagtcagggaaaacaaaggggatggggtaggggctctttatttaaaagatactcatagaaatgaacgaagtaatttgaaaactaggtctcagaataggacatgaagtataagagttctaaaatctcaaaagcaggaacacatgcatcttctttttaagtgttgtctttgaaatactaagctccaaagtctttccaaccttgtattattttcttcctttgtcagcttcctgagtggcagagtctgagtaacctatggggtctttgaactctttaggggaattgaggaaggcaaaaaggtaccatgattggcagctctactagagtcacaagaaatatggggaaagcgattcctcaaaggaaaaacaaaaacagaaacaacaaccaggcagttagtagaaggatgaaatactggacccacaaagacaacatatgtcttctcaccacacttggtctctctctctctctctctctctcacccttctctctctctcatagtaatgaaactaaagctgcaaaactaaggcctagctattcattgtgatccttatgagatcataaaaaaaatctgtatttaagtggagaaaaataaatggaatatcaactttaaaaaattttttttgagacagagtctcgctccgtggcccagactggagtccaatggcatgatctcagctcactgcaacctctggctcccgggttcaagcaattctcctgcctcagcctcctgagtagctgggactacaggcacgtgccaccacacccagctaatttttgtattttcagtagagacagagtttcaccatgttggccaggctgttccgaaactcctgacctcaggtgatccacccacctcgacctcccaaagtgctgggattacaggcacgagccactgcacccagctggaatatcgatttaattgtaagagaaaaatgcactagtttaaaaatgtgtcctctttatcctcaggttttaaaaatatttttaaggtagtttagaaaaactgaagtgattatttgataaataaatttcaaatgctatcaatggaacaagaatggatattagatatcctgctaacaaggatcatatttttacaagttgtttctccaaagagaacagagctacagctgagattctggtgcgcataaacctttccatcagagctgtagtcacctaacaattcttatatcacaatcttcatatctcaatcccttttccaaataacttcatctttcttaagttgcatacaaatgttataatctaatatttttgagatggatatcatgtgtcataaaaagaaagccattgtaatattaccaataccaagtattagcaaatattgacatagctttagaataaaaataaacagagctcaggttctggctctgccatagctagctagatttatcttaagacttcagtttcctcatatacaaaatgttgatagtatcatcatcttgtaagccttgttgtaaagagcaatttagctaacagtaacagtgtttaacatgcataaagtgaagactcctttctgggctgataagaacgctagtttattcatttgcttatttctatatttttaagcttagagtctgaaaattttcagagtctgggagtcaacgtgtggggtgtgaattggaacttcaccacttactaacaactcccttttgtagtgcttccatttatttatctgttcaataggagtaataatagcactcgctcaaagagttgtctgaggattagatgagacaatgcttgcaaaatgcaaagtggagcacctggtgtatagttggtattcaataatttctagttgttgatatgatgatgacgatgatgatgtattctcttgatatgtgaatgctcatcacaccatcctatggaatatttgattttaagaaaaagttgggtttgttttttttttttgtttttttttttttttgagatggagtctcactctgtcgcccaggccagagtgcagtggcgcaatctcggctcactgcaacctctgtctcctgggtttaagcaattcccctgcctcagcctccagagtagctgggactacaggcgtccgccaccatgcccggctaatttttgtatttttagtggagaccgggtttcaccatatttggccaggctggtctcgaactcctgatcttgtgatccacctgcctcggcctcccaaagtgctgggatgacaggcatgagccaccatgcccagccaagaaaaaatattttaaacaagttaagatcatttactatactgtgccctaagatgaggtgaacatgtagatcatgagatctaattgattttagatgcagttcagttttttaaaagaatgacctgctttccatattaaaatttcaaaacaatgatatgtggagatgatgacagaatatggctgaatgaggtaccttgttatcctcaaccttttggctcagagacctcttccttgctggaaactttcctaaccttttaatgatttattaacattttgcatgcactctttatacctttcattaatgactagttcactgcaaatttttctttgctttatttcctattcttggtgtgacattcattctctatctgtttctatggaagcttttgtgatgcctcagagagaaagaattctgagtctttgaaataatgaaaacattactaaaccataaaacctagatttcaggagcctaatagaggattagagctttattacgtacagccatcttacagtttagccttcaagtctcaattgtggaatgatcttttgtcctttctctccagtgtgcatgtgtgcatacacatatagacacagttcgcgcttcagtcatataaatgggaagccacaaagcttcctagagtacccagatgcagaattagaagacccaatcttgacaccagggtcaggggatctgtggtttggggggacttgtgctggctatattgttgtcacagcaggaacagtttgtgtcggtatagaggctttaacttctagtaaagggatatataatgaaaatgtaagcaaccatcgtttatttttctcacataataggaatttaagagaaagatatacccaaaattggtttattagctcaacagtttcattcagaatccaatgtctttccatctttgcatttgctatccttagcctttggctttggtctttggaattgtcacgcgatggttataaaatggctgccacactccaggaattgcatcatgacagtgtgaatggaaaataaaggaagagtggcagttcttgtcatgtttcagaagcaacagcatgtctccctaacatctctttggccagaactaggtcaagtagctgcatctacctgcaagggaaactaagaaattgactatcagtgctttttaaacttttttttgtgtgtgtggaaatagataatcactagagaaaaaagggagagtggaatggttgttgatgaggcaaccaacagtgtctaccactctatttataaaccttttcttgatttttcctactaaatgtgtggccgttttttttgcttgctttttgttttttgtttttgagatggagcctcactctctcccccaggctggagtgcagtggcgtgatctcggctcactgcaacctccgcctcccaggttcaagcaattctcctgcctcagcctcctgagtagctgggattacaggtgtgtgccaccacgcccagctaatttttgtatttttaggagacatggggtttcaccatgttgatcatgctggtctcgaactccagacctcgtgatccgcccatctcagcctcccaaagtgctgggattacaggtgtgagtcaccgcacccagccaatgtgtagccttttagttcaaggacctttcattataaatcttcatagtccaaacacccggcatattgtctggcacaaaataggaagaaatatttttggacgtgccaaggaatttgcaagacagtgagacaaatagccagtaaaaatgttagcattaatatattattaaaaatagtgagaaatgctccaggcgcagtggctcatgcctgtaatcccagcactttgggaccccgaggcgggcggatcacttgaggtcaggagttcaagaccagcctgaccaacatggtgaaaccctgtctgtacttccagctacttaagaggctgaggccggagaattgctggaacccaagaggcggaggttgcagtgagccgagatcacgtcactgtgctccagcctgggtgatagggcaagactctgtctcaaaaaaataaaaataaaataaaaagaaaaatagtgagaaatgttatgaagacaaagaataggctactttggaagaataatagtgggaacttcttcatagtctaggaaggcctctctgaaaaggatatatttaagctaaaatctgaaggttaggtcagtcatatgaacagggaggggaatggaataatattttcaagacaatgacctaaaaggaggcaagtatggctaggagctaatgactgagggggtgagtggtacaggacaaggctggagagtttattttatgggtaagcagagaaataatataatctgacgtacctgtgaaagtacacctgagctgatgtacctgcaaaacatcatacaatctgatggacctgctgtataaatgagagattgaatgtggcaagagtagaagcaaagaggccaggtaagaggcatttgcagttgtcttgatgaaagaaaatgactactgggagtaagatggcggcaatggaaatagagagaaatgaacagatttgagatgtattttcgagacaaaatctgtatgacttggtgatggattagatgtcaggcatgagggattgaggatgactcccaagttttttttgtttgatcaacttgttgtactgtttgctgaggtgataaagatggaggaggaagcagatttggaaaagatcaacagttcagttttagacatgttcagtttgaaatgtgtgtgatatgtccaagtgcagaagtcaaattcaattatagctcaaaggagagacccgagctagaagcgtaaatgagaaaaatattgatacaaaatggaatttagagcatccagaatggaaatcacttagcatgtaaagagggaagggaagatggcctaggaccaaaccttgataaacttcaagaaaaagaagtcaagcagaggtaggagaagagaagtcagtcaaaaatcaaaagaatatgacatctcagaattcaaggatgtgaataaatgtgtaagtgatggatggctttcggtctgggctttttgttttttttttccattttaagttccaactttgctacaatccggctacgaatcccacaccctcccaaattatctgaggatgttaattgatacttgatcagaaagcagtgatttttaaaatcatatacttctaaattatctgagatatgaagcaatgagatagggaagtggctgaaatatgtttctctggctcagctgtcatgagggcttgctctagaatggcactcaagcacatgtttatccactgagctctatatcatttattccattagctgaagaaggaatctctcacactctaacttcagttctgttggacatgggaataaaagttagatgtatacagactaaactaaacagatggtagaaaaacaaaggattcttaaagtatattggagaaatgcatttctatggtcaattttcttgaatatcctaagatcaggtttcatgtatataattctttacatttcacaaagcacctttagatgtgtctattccatttaaccctcatcctaactgtgtgaagtagggcacagaagtgtagaaatgattttttaaaactcactaagctaatcaatggataatctgtgattataatagaatctgagtttcggcatctttatcttattccttactgcactatatctggaatggtaaatattgttcatctcacaagcaagctcttattgactgatatcagctgcctagagtggtttattgtaaaagagcataaagcaaattggggaagactacaatacagtgccataggctgattagtaatttctaccattggtattaaatgagaaaataatggtacaagtgctttacatttgtctgccattcctaaactaaggcacctcctgttatttataaggaagaatattctgagaagtttaaaagtctcttgttaaatcatttgatgacgttggataaaatggcttaaaataagaatatgcctgttgcacaaataatctacactcccccaagataatgaataagtcagctggagcatctcaagtttcaatatgtagaggatcaaaatgaaatagtcataaaaccccttgcagacatttcttgggcaggcaaactaatttcctagtaaaagaagttggaagttggacaaattgtatatgggaactttctatactacttttgcaaattttctgtaagtttaacttttcctaataggatgctgagattcagctcttccaatggtctcaaatgttttttggttttgttttgttttgttttttgagacggagtctcactctgtcacccaggctggagtgcagtggcgtgatcttggctcactgcaacctccacctcacgggttcaagcaattctcctgcctcagcctcccaagcagctgggattacaagtgcctgccaccatgcctggctaatttttgtatttttagtagagacgggattttgccatgttggtcaggctggtctcaaactcctgacctcaggtgatccgcccaccttggcctcctaaagtgctgggattacaggcatgagccaccgctcctggcctcatttaaccattttgactttcactttttctgtcttcaaaatgaggtattgagctaggtaaacttaatgtcttttttcgctttaattatctaataattctgtgattctcaacttggtgtgttaaaccagattacacctaagaaaccctgaagactttttagctaggagtttaaatattcacttagtcattcaattaatatctattgtgggtctgttatatgccaggcgccattttaggtattgataataaagcagcaaacaagacaaaacccctgccctcaggagagcttacattcttgtaaagaagacagatgataggccgggcgtggtggctcactcctgtaatctcagcactttgggaggccaaggcgggtggatcacgaggtcaggagatcgagaccgtcctggctaacatggtgaaactccgtctctactaaaaatacaaaaaaaaaattagccgggcttggtggtgggcacctgtagtcccagctactcgggaggctgaggcaggagaatggcatgaacctgggagctggagattgcagtgagccgagatcgtgccactgcactccagcctgggtgactgagcaagattccatctcaaaaaaaaaaaaaaccgaaaaacaaagaagaaagatgataaacaagtacacaattatcatataacaattttaaatagtgacagcatgttgaaataaataaagcaaggaagacgctagagagttgttcatggaaggaattgtcattttatataaggtgatcagggaaggttccactgaggaggtgacatttgaggaaagacctgaaagaagtggggagggagacccgaaagttcatgaggaattgtgtcccaaacagggcaacacataaaaagtccttgaggcaagactaagctgattatataacatttaaaagaattaggccaggtgtggtggctcacacctgtaatcccagcacttttggaggccaaggcgggtggatcacctgaggtcaggagttcaagaccagcctggccaacatggcaaaaccgcgtctctactaaaaatacaaaacttagccaggcatagtggtgcatgcccatagtcccggctacttgggaggctgaggcaggagagtcacatgaacccaggaggcagaggatgcagtgagccaagattgcaccactgtactccagcctgggtgacagagcgagactctgtctcaaacaaaaaaaaaaagaattaatttacatatcatgagatcatctagtctaacacccttactagacaagttcaaaaaggttaagacttggccaagatgacacagctatttaatgtgatatctgggttagaattcacctcatctgaattcctctcaaattgtgctctttgaggtcaatgtgccttttaaaaaatgacagaaagcatggctgtagatttcagatcataccaaatttgatggaacaatgaccatttttagcttcctatagagtctaagacttgaacttgccaagggagtcacagctggatttgtaagcatcaaatccacaaatgtacttaatgtcaaccaaggattttgtgtcacctgtaatgctcccccaggaagcccccaagtccactagtcctaatcactgtgtttggcttcataacctgttggcccaaacattacgcaaaaaagagcaatattcccaaggtggtcatgttagttgtggtgagatgtcaaccataagtagatctgaccgaggaaatgccttaaggaagcagctcaggaacacctgagtatatgtgtctagaatgaagcctattaaaaaaactactgcagagctaaagacagctgaaagccattatgacagtcacaactacttgatagattgaaaccaaagagttcctttgtgattagatagatcaggactctaaatcatgtttttacttcatgtgttcattcattcatcatacagtcagtgattcagtaaacaatattgagcatccattatgtgccaagcactgtgttaaattctggaaacacagagatggattagacccctgtccccagggagcataaagactagcagagttagacctccctcccatatgaagaaattaaatgaggtaaggcattaaaagtgctatgattacataatacagaacccaaaggggaaggcattttctgaaaaacagaaaactgaaaataccagcttttcagcctcacacagacataggaaaaccaacccccatcaacatcatctcttcttttttttttattattactatagtttaagttctagggtacatgtgcacaacgtgcaggtttgttacatatgtatacatgtgccatgttggtgtgctgcacccattaactcgtcatttacattaggtatatctcctaatgctatccctcctccctcccctcaccccaaaacagtccctggtgtgtgatgttctccttcctgtgtccatgtgttctcattgttcaattcccacttatgagtgagaacatgcaatgtttggttttctgtccttgtgatagtttgctgagaatgatggtttccagcttcatccatgtccctacaaaggatatgaattcatccttttttatggctgcatagtattccatggtgtatatgtgccacattttcttaatccagtctatcattgatggacatttgggttggttccaaatctttgctattgtgaacagtgccgcaataaacatacgtgtgcatgtgtcttcatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgctatttctccacatcctctctggcatctgttgtttcctgacttttgaatgatagccattctaactggtgtgagatggtacctcattgtggttttgatttgcatttctctgaacatcatctcttaatataaaaagcataatgtgctgatttcacattgcatgcctgtatcaaaacatctcatatgctctataaatatatacgcttaatgtgtacctacaaaaattataagaattttttttaaagcaacaataaatatcttcattagtcaaccaaattaaatctattaatatatccatgtttgtgaacaggatggccacagaaccctgtggatgcttaccacttaaacatttcctgaaacaaatatgtttccaaaacatcttgcctgtctaatctgacaactgcagacatcctaactaggctctgaaggtgctctccatagcactgatgttattgattcagttgttaacagcgcaggcataaatgactgatgataactctctaaacgtcccttcctactgccgttgaaatggctctgggctttatccaagcagggctgctaaatgaatagtagatgtaccagcagaggagaaattggtcctgaggtgaattaactctcctgaggtagatttgtttgtgcttccaacaacctgtacgttaaaccttgtgaaccttcatgtaggaattttgaggagaaatgggcaatttttggaaagcctaatgttttatcagccgctttttcttctcattgagacctgtgtattctcaagggactttggaagtttgccattttaagaacagacttgatgagaattatttgaagtcctccacgtttccatttatcagttttcctaatacagacatcctacgcacatcgttgaaagaatgttctttttgcctcacaggtagatcacaaaagtgggcccataatcattgggtagagggtttctcagctctgagttaaattgcagctgggtattgtttttctgtaataggatcttctctgagtgaatggtgaaacatgcccatttttgaggtcatgagagcagagctttccacatcatggacagaaaagggcaaccggccatggtttcagttatacagggagaggaaacaataggttttgtctctgctttgctattgcttcaacagcagcatactgttggacactcagacattagggcacaatttagacttgtttcacagctgtcatttctttcctcaaaaacaacaaacctgcatgggggaaatgagtctacatttcagggtttttcaagaattgataacataacatgtacttcaccatgaatttatattccacaggtccctgttctcttctctggtcatcagagtacaaaatcacaaccaaaaagcaagaattgatatctatgaagctaaagtagtagtagtagtagtagtagtagtagtagtagtagtagtagtagtagtagtgaagcaggatattaccctgatcccctcgcgggcgggaactggactgcatagccgcttcggtgctggcaggggcagactccactggctcagtctcactgagttccacccctcatgggagaggaagcacaggtgagtgggtacaggagccagggtgagtgcttttgggcgccagcaggaacaaaactctgtgtgggccccatggcagtgtctaggagggtgcccgcgacccttgaatccccagaaggagtgttacagggcccttttatctttgccatctgcagatggcttaagtgttaacagctcagtggagggtcagtgtgacagccttctgtactcgcacttgtggcacctcagatcttgcccattttccaggaggaatgaggtcacacaaactaattggagatggtaaatgcgggggattttattgctgatgaaagtggctctcagcaggaaaaggagctgaaaaggggacagagcaggaaggtaatcttcacctcgagtccagctgtccgcaatcagactcctctctgaagctatgctgccaggctgtccctcggaagtcaagccacttctctccaatgcacaaccatagtttccaacatccagctgcttctcctctgtgccggctgagcctgggatttttacaggcacaggatggagggcagggtgggctatgggtggttttggaaaaggcaacatttgagcaggaaaacagggatgtaagttctcactttgggccacagttccaggcttttaggcttaagggtggggcccttgccagagacccgccctcttctgtccagaatttccctgcctcctgtccctatcagtagtaatagtagtagtagtagcagcagcaacagaagtaatactaactactacataccaagcattatctacgtacttcatatctattcaccaacctaattgttacaactttcactcgcgtccgtgtgaagagaccaccaaacagtctttgtgtgagcaataaagctttgtaatcacctgggcgcaggcgagctgagtccgaaaagagtcagcgaagggagataggggtagggccgttctataagatttgggtaggttaaggaaaattacagtcaaaggggggttgtcctctggtgggcaggagtggggatcacaaggtgctcagtgggggagcttttgagccaggaagagccaggagaaggaatttcacaaggtaatgtcatcagttaaggcaaggaccggccattttcacttcttttgtggtggaatgtcatcagttaaggcaggaacaggccatttaaatttcacttcttttgtgatttttcagttacttcaggccatctggatgtatatgtgtaggtcacaggggatatgatggcttagcttgggctcagaggcctgacattcctgtcttcttatattaataagaaaaataaaacaaaatagtgttgaagtgttggggcggcgaaaattttcggggtggtgtggagagataatgggtgatgtttctcagggctgcttcgaggtggatcaggggtggcgtgggaacctagagtgggagggattaagctgaaggaagattttgtggtaaggggtgatattgtggggttgttagaagaaacatttgtcatgtagaattattggtgatggcctggatacggttttgtatgaattgaaaaactaaacggaataagagaaggagaaaaacaggtattaaaggacgaagaattgggaggacctaggacgtctaattagagagtgcctaaggaggttcagcatagccttgccagcaaagattatttactttaagagttaagagtggtggtttggggatagcaccaagagatatcagctgtgatggcttggagaaacagtgtaaaccagcagtgtaaacaagagcagggcatttatgactagttgagactggtgaataggagtatgactagacagaagataggagggatgacaagttttttggggtgcagtctaagttggtctggtgtctggaatgagactggggcctaataaaaaggagcgtccatacaggagcttaaatgggctgtaccttgtagcattctgaggacaggcctgaattctgagaagggcaagtggtaaaagtattgtccagtcctttttaagttggtggctgagcttggtgaggtgtgtttttaaaagaccattagttcactgaatactaagagcctgagaaactgcttgggtgatttgactaataaagtccagtctgttataggaccgtatagaggtgggaaggccaaaccgaggaattatgtttccctgtgggaaaggcctctacctatccagtgaaagtgtctacctagaccaagaggtattttagtttcttgactcggggcatgtttagtaaagccaatttgccagtcctgggcgggggcaaatcctcgaacttgatgtgtggggaagggagggggcctgaataatccctgaggagtagtagaatagcagatggaacactgagaagttatttctttgaggatagatttccacgatggaaaggaaatgagaagttctaagaggcaggctagtggcttgtactatagcatagcctgcctttgctggtgtgtggccattaggcctggtggaactgccatcaataaaccaagtgtgatcagggtgaggaacaggaaagaaggaaatatggggaaatggggttgaatgtctggtggatcagagatacagtcatgggggtcaggcgtggtatcaggaataatgtgggaggccggattgaagtctgggccaggaacaatggtaattgtgggagactcaacaaagagtgagtacagctgaaggagccggggagcagaaagcatatgcgtcaggtgtgaggaagaaaatagattttggaagttatgagaactgtagagagtgagttgagcatagtttgtgattttgagggcctctaaaagtattagggtggtggcggctgccgcacgcagacatgagggctaggcaaaacagtaaggtcaagttgtttggataaaaaggctacaggacgtgatcccagtccttatgtaagaatcctgactgcacagccctgcacttcagcggtgtgtaatgaaaagggttgggatgagtcagggagagctcgggtgggagcagtctctaaagctgtcttcaaggaatggaaagaggagtggggaaaggatttaggatctatggggtcagctaggtttccttttgtgagtttatataatggttttgttaggatggcaaaaccaggtatctaaagtcgaaagtatctaaccatgcctaggaggaaaaaacttgttgttttctagaagggattggggtttgggagattagtcagacatgatcagcagggagagcacgtgtgtttttatgagaattatgccgagataggtaacaggtgaggaagaaatttgggcttgactgaagtaatgggggctgtctgtgaagccttgaggcagtacagcccaggtaatttgctgagcctgatgggtgtcagggtcagtccaagtgaaagtgaagagaggctggggtgaagggtgcaaaggaatagtgaagaaagcatgtttgagatccagaacagaataatgggttgtggagggaggtattgaggacaggagagtatatgggtttggcaccacagggttgataggcaaaacaatttggttgataaggtgcagatcctgaactaacctgtaaaccttgtctgcttttaggacaggtaaaatgggggaattgtaaggggagtttataggctttaaaaggccatgctgtagcaggcgagtgataacagactgtaatccttttaaagcgtgctgtgggatgggatgttggcattgagcggagtaagggtgattaggttttaatgggatggtaaggggtgcatgattggtcgctaaggagggagtagaggtgtcttatgcttgtgggttaaggtggggagatacaaggggagatgtgaaggaggctttgaactgggggaaaaggcggcaatgaggtgtggctctagcctaggaatagtcagggaagcagatcatttagttaaagtgtctcggcctaatagggaactgggcaggtggggataactaaaaaggagtgcttaaaagagtatcgtctaagttggcaccagagtttgggagttttaagaggtttagaagcctggccgtcaatacctacaacagttatggaggtaagggaaacaggcccttgaaaagaaggtaatgtggagtgggtagcctccgtattgattaagaaggggacggacttaccctccactgtgagagttacctgaagatcggcatctgtgatggtctagggggcttctgaggcaatcgggcagcgtcagtcttcagccactaaaccgagaagatctgggaaggagtcagagagccttgggccagagttccaggggctctgggagtggctgccaggtgagttgaacagtccgattttcagtggggtcctccacagatgggacatggcttaggaggaatcccgggctgcgggcattccttggcccagtggccagatttctggcacttgtagcaagctcctgggggaggccattctggaggaacccctcgcagctgcagttcaggcatttggagttcttctgtgctggagatatggctggggtttgtctcacagtggagggaaggaattgcaactcagaaatacattgctacttggctgcctctactttattattgtacaccttgaaggcgaggttaattaagtcttgtggggtttgagggctggaatttaatttttggagtttaatgtcgggagcagattgggtaataaaatatatattgagaataagacggccttttgaccttttagggtctagggctgtaaagcatctcagggttgttgccaaacgagccatgaactgggcttgtttttttatttgatgaaaaagagcctaaacgctatctgatttgggataaagaaaaaggagcattaaccttgactatgcctttagctccagccacctttttaagaggaaattgctgggcaggtgggggagggctagtcatggaaggaaactgtaagccggaccgggtgtgaggagcggaggtgataaaaggattatagggtggaggagcagaggctgaggaataattgggcctggcgaggaggggagaggtcagatgggtctgtagaaaaggaagattagaaagactgagcgatgcttggggttgggactgaggggacaggtgggagggaaagaaggaagatttggaaggagttgcattgggaacagagactggggaggggcagatgtgtaaaagaatgcctggacatcaggcacctcagaccgtttgcctattttatgacaagaattatttagagcttgtaggatggaaaaattgaaagtgccgttttctggctatttggaactactgtcaagtttgtactggggtcaagtggcatcgcagaagaaaataaggcatttaggttttaggtcaggtgtgagttgaagaggttttaagttcttgagagcacaggctaagggagaaaaaggaggaatggagggtggaaggttgcccatagtgaaggaggcaagcccagagaaaagggagtagagacacggagagaaggggtggggggttcttgtcccccagaaaagcggagaaggggtagagacatggagagaagggttggggggttcttgcccccgagaaaagcggtacttgccgctaaaggtgaaggaccaaggcaggcgtccccgtgtggtcagacacctctgaaatgtgggtgaataatcaggcaggcatccccgcgtgattaaataccaagggaagactcttccgagtccgtgaccggtgccggagttttgggtccacggataaaacgcatctcctgtctctaccagaaaaggaaaggaactgaagttaagagaagggagagattgaagtggggcgccaagattgaaaggagaaagaggttgagggatagtgagaggttggaggagagagtaaaaagaggccgcttacctgatttaaaattggtgtgatgttccttgggctggttagtctgaggaccagaggtcgtaggtggatctttctcacagagcaaggagcaggaggacaggggatagatctcccaagggaggtcccctgatccgagtgatggcaccaaatttcatgcgcgtccgtgtgaagagaccaccaaacaggctttgtgtgagcaataaaactttttaatcacctggatgcaggcgggctgagtccaaaaagagtcagcaaagggagacaggggtggggccgttttataagatttgggtaggtaaaggaaaattacagtcaaatggggggtggttttctggcgggcaggagtgggagtcacaaggtgctcagtggggaagctttttgagccaggatgagccagggaaaggaatttcacaaggtaatgtcatcagttaaggcaaggaccggccattttcacttcttttgtggtggaatgtcatcagttaaggcaggaacaggccattttcacttcttttgtgatttttcagttacttcaggccttctggatgtatacgtgcaggtcacaggggatatgatggcttagcttgggctcagaggcctgacaacaacgatcttgtagataggtactgttgtaattcccagtttacaaataagaagactaaggtatagagagattgagtaatttgcccaaagcccacagctagtaagaagccaagattcaaacccaggtaatatggctgcagacctggtaatcctaaccattacattaggctgactctcgatagttaacttatttaagctagtgttaatcacatcttaacaagtttgagtaataaaatcttaggttgaaaggggccttcaagatctagtctaaatcctttcaggagttcttccacatttctgctagaaaacactttggcctaggcttaaaacttagtgatggggaactcctcactttgtaaagcagcctgttcagttcacaaacaccctaataattaggctgttatctcttgcattgagctgaagttgatcttcccataacctctgcctttctgtctatatgtatgctttggaaatatacacagtaagtgtaaaccctcttggcaaagacagcccttcaaatacttgggaggcattcaattccccccgccacctcccgctctactctcactaccaagtctttagaatagagtacaggtatcaaaatcaaaacaaacagggagtagaaacttagtgccagactttaagtattttttacttataaaatctttttgtgtaacgagtagagcaactcctaactgcatatatgtactaagtttgcaaatggggcaatttgtttttccccatgcactggcatcagaggtggtaaatgctggcctgtcagattcaatgcattttgctgggttagaaccgcaagggctttccaggggaccaagctctctctgctgtaatcattaaaacctgcagaatcctgtgtgactctggggagaagcccagtgctcttggccctcatccaccctcactaggaaagctgcttaaaactaggacagaagaaacaaccactggcttaggatcagtcctcagacctgccttggcactaccccttttattccaaattttgcagtggcacctccaacttcttggtcacgttttgtaccttgtctgtttcctcatataacttcattccaaattccaacccatgctctgacatttcctctccattcttgctagacaggaatttctggatattggatattggcccctgcccataccctgactctgtatattcttttgtcctgctgaccagtttgagcttctgaataacaaaaactccccaaccactttaaagtcctctactttagcttgatgggtccctctcctgtattttctgaccttgactctgctctctgtacaaatagtaattacactcacccccaagcagagaatctgtgtcaaaatccatcaggatatctaagcacatcattatatctgtcaacttccccagactcctgatctcaatcccttattttcaacaacctggcaccgacagagtataatttcttttgtatcatgatgcagtttgatgtgcttttcgaaaggttatggtggtgattttaaagagatctgttttgttagaggaaggaaggaaaatagtgctgtttgcttccatgcagttcctcagagcctatgccagggtgatttcagctcatgagagaatctaaagtctaaagagatgtgtggagattagaaacattggtgtaaaaaatcagattacggagacgtaatatccagggtgtcagaggaggcagggagcttcaatcatgtttgaaactataggtcccacccaacaggatgagaaaatacaggagaagccagaaaaggtacctgcttgtgggtaaaatcaattaaatggaatcaatggtatggtagccatcatttctttcttttcaaattgtggtaaaaacacataatgtaaaatttaccattttaaccattttttagagtatagttcagtaatgttaagtatattcatgttgtcatgtagtggacttgcagaactttttcaccttgcaaatctgaaactgtacccattaaaccacttctcatttcctcctttcccccagcccctggcagccatctttctactttccgtctctatgcatttgactattctaggaacatcatgtaagcggaattatacagtatttgttcctttttggactggcttatttcacgtagcataatgtcctcaagtatcacctattagctgtcattgcttgaacacggttttctgccaagcacatgatctcgttttattcccagcacaactctcaataacaactgtgtaccttttttccctttcacagattaggaataaaaggctctccaagactaggctcagaagcagaagcagttggagagttgcttgcagaaggattattgtcatactgggaagtgctctcaggatttacacctctaagaaactgaaaggggcatgactgcgcagaggaaaagctggttcaccatgcagttgcaattatggctgcagcaggagcatgcagggaagctctggagtaggtttggcctttcagagttgtccccagtaaatcaaatgggtgaagactttaacccatttatgctggaggttgcaaaaatgttttgtgaaaagtcagaccttggcgatgaccttgagcagtaggatataaaaaactcccacaagcttagcgtcccaataatggaacactaggcataaatgagttaatccctgcatcagccagtcattggccctaggtctctccctgagggaggggatgtagctgtgtgaggcagttccctgagggcacattccaatgaaggccccagctgtgagccagcagccaataaggcagcaggtggcccatgcatgcaaaggccctaaagaggaggtccagggtggagcgccacggtgtctactacagatgctgaaagagtaaatacattttatttatttatttatttattttattatactttaagttttagggtacatgtgcacaatgtgcaggttagttacatgtgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggtcttttgtccatgtgatagtttactgagaatgatgatttccaatttcatccatgtccctacaaaggacatgaactcatcattttttatggctgcatagtattccatggtgcgtatgtgccacattttcttaatccagcctatcattgttggacatttgggttggttccaagtctttgctgttgtgaatagtgccacaataaacgtacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgaccgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtacatttgtttgagttcattgtagattctggatattagccctttgtcagatgagcaggttgcgaaaatttttctcccattttgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctgaatggtaatgcctaggttttcttctagagtttttgtggttttaggtctaacatttaagtctttaatccatcttgaattaattttcgtataaggtgtaaggaagggatccagtttcagctttctacatatggctagccagttttcccagcaccatttattaaatagggaatcctttccccattgcttgtttttctcaggtttgtcaaagatcagatggttgtagatatgcggcattatttctgagggctctgttctgttccattgatctatgtctctgttttggtaccagtaccatgctgttttgcttcctgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaatttccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgcacattgcttttgtatcctgagactttgctgaagttgcttatcagcttaaggagatttggggttgagacgatggggttttctagatatacaatcatgtcatctgcaaacagggacaatttgacttcctcttttcctaattgaataccctttatttccttctcctgcctgattgccctggccagaacttccaacactatgttgaataggagtggtaagagagggcatccctgtcttgtgccagttttcagagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttgtaaatacattttttaaggtcacacaaatgacatatgggacagaacagtgtttaacttcaaaactcatgttctttctgctatactgggccttctctccgaaagaggcctaatttgcacactacagtcaagcttagaatctattcatagttaaaatgtggagtcaaagcccaggaactatgtccttcaattcatctttcattacttacctattccttatcattcccgctgacaccaaccattttttctgacccttgtcatgaggagtgaagttgtatcattgcagcagctttctacttgtactctatgcctaaaatctctccttcctccatctggtcagccaattgctgtcaagttaatcttgcaagaacactacttttgccagtttaatttcgcaaaactcctgctgtgtgccaggagtgtcccagacatcaggtagtctaagataagcgatagtctctgcccctaagccgtttgcaacctttggagagacaacgtcattatcaccaccagcacccccattaagctcagagctaatatatgccagatgagactctgccagtcactgtgctaaggacttgacatacgttatctcccttaattctaacaactactttctgaggtacctctgatgagtagtatcatttttagatacaaaagcagaaacttagcgagttaagtgctttgcccagtggctctcagttgagaaacgaggtagtcacaccaggcagtccaacttcagtacctgagttcttaatcatcatgtttacaactttggctcaacattgtcaccaagatcgggttcaaatacatccattatcaatattctttctgtctccttgtatgtccaaacaaacaaaacaaatgcttccctcctgatgaggaaagtctccaaatcttgatacctgctgtgtctggacagtttttcctgctatttgctgagtgctggaaggattccctcaatccagatgtgattgcagatccagctcaagctcagcgtcctccagggaacctttgaactaaccacccagaaacgagcctttcaccggacactactcattttcacatatctagatcttatttccccatctgaactgtaagtgtcttaagagctgattttgttgttttttaataaaaaataattcttagttttttttcttattaccaaaaaattattcgccattgaagccttctgaatttttaataagaaaactattggtatattgcttcaaaaagaaatctaagcttctagattcttgaaaagggatagtgacagaaccttagaattaatattcaatataactaatctgatgaaaattcagtcattgatacattactgagaactactagatctcagcatttttaattgtagattcacatggagttgtaagaaattatacacggactccacatacctttttaccgagtttcctctaatggtacacctgcaaaactctagttcaatgtcacaaccaggattttgacgtcaatattgtcagtatacagaacattttcatcactacaaagatccctcctattggccttttatagccacacccacttccctgccccccctacctcctacttccagcaactactagtctgttttccatttctttaattttgttatttcaataatgttatatgaatggaaccatacagtatgtaatattttgggatggacttgactcactcaacataattccctagagatttctctttttatatgcagcaagacttgtttcctttttatcgtgagttgtatgctatggtttggatataccctagtttatttaatcactcaccccttgaagacatctgagttatctgtagttttggactattgtgaataaagctaccaacattaatgtacaggtttttgtgtgaacataagtttttatttccctgagataaatgctgaagagtgcaattgttaggtcatatggtagttgaatgtttagttttaaaactgccaaacttttccgaagcgtctgtactattttatattccaccagcaatgtatgagtgatccagtttctctgcatcttcaccaacatttggtgttgtcattattttttatttttagccattctgatatgtgtgtaggaatatctcattgtgcttttaatttacgtttccctcgtggcaaatgctgttgaacaacttttcctgtacttgtttgccatatgtatatcctcctcattgaaatgtctgttcatgtcttttgtctattttctaattcaaaagtttttttatagttcggttttgagagttctttctgtatcagatactagtcctttcttgtgtatagggttttcaaatgttttctctctcatcttttcatcttcttaacaggggatgaaaaagaattttaattttggcgaggttgaatttatcgctttttccttttatggatcatgcttttgtgttgagtctaagaatactttgcctagccctggatcccaaagattttctcctgttcttttttttttttttttttgagacggagcctcgctctgtcgcccagcttggagtgcagtggcccgatcttggctcactgcaagttccgcctcccgggttcacgccattctcctgcctcagcctcccgagtagctgggactacaggcctccaccaccacacccagctaattttttgtatttttagtagagacggggtttcaccattttggctctcctgttttatatgtcttatagttttacattttatgtttaagtctgtgatccatttgatttttatataaagtatgaggtttaagttgaggtttattttttgcatatggatgttcaattgctctagcataattatttgaaatggctggcttgattattgaagtaaggtcagacttatttctctcctgggcttcagacccagccaccttctatgtttcttgtccaccacaacctgaatgtcccacagacacctcagacttaacatgtccccagcagctcattattatcctccttttgtcccaatccaccctcaacatttttccctccctaattgtgctgttcttatgaacgctacgcttcacccaattgcccaagtcaaaaattagggtattatttctgaatctacttttatctttaaatctaacatgatgcattgccaaattctgtcagctctatccccaagccatctcttaattcattcccttatttacacctcccttgactccaatatcttttgactcaaatgctacatagcctctaatttatctccctgatattgttcttgcttccgaatcccttttccacaatgcgcctatagtaatcctcctaaaatgcagatctgattaggtgactctccttattttaaagtctttcttattgttttctcctgccctaaggcagaagttccaacaaatcttgttatcagattctggattaaatcccggcctcagcagtgggacctaagatagtgcctgaatttccatgaacatttattgatgacaaagagggtcttaaataatgagtgatgtagactttccactgtcaacatcacagattctggtttttaatggtattcacatttgccttctccaagagtccaggtttaatgatggtgagacctatcctaagacctggctttgtagtgaggggttacctcatcacagaatcaagaagggacctcgggccgggcatggtggctcatgcctgtaataccagtactttgggaggttgaggtgggcagatcacctgaggtcaggagttccagaccagcctggccaacatggtgaaaccctgtctctactaaaaatacaaaaattagctgggcttggtggcacacacctgtaatcccagctacttgggaggctgagacaggagaatctcttgaacccgggaggcagaggctgcactgagccgagattgcaccactgcactccagcctgggcgacagagcaagactctgtctcaaaaaaaaaagggcggggggacctgggtgcaagtaattctaagaagcaggaataagagaacaagaagaatgaagcgacaaagaaagatgagcaattctctggaactgttgagaagtgtacagaagaaaacaaatctggatataggtagctacagcctgaaatatggaaagccagagcatgtgtatacctgctcctgctcccactggttgagaattgattcctttttcatctgatatgggcaagcattggatctgagtgggacacatcctctccagtgcacccctgccttttccgctgctctgaacttcacacaacgtcggaaagattcaaaacaatgtagaaaatctaagtataaatacaaaaaggaaacaagaagtttttctatcaaagctgtgaactatatgatatgagtaagctcaataaacactgtgcagaagttgggaggggaaaaagagaattgctgccaaagcactaacccctgtggctggctatgcttgcccacccaggaagctcccatgtcatgggggtcaggggaacctagaacagaaagctgaaaggctcagggatcccttttgagaagggatgctggctatacagcacgagttagaacttgcacagaaccgtccactactgctgacactggaatcacaggtgggctgacaagatgtgatgcaagcaccagacatatttgctacaaacctcaaagtggagcagagcagcggcagtgtcagtcttcttggtgtcaatagaatacctgtttatttgttgaattctccctatatgaataataataatacaagaattcaaagcaggataggctttgtgtcattggaggagtatggagaaccatcagtgcagtaagtgtcgtgggaggtttctagacagtttttaaaagtcgatattgagtcaaccatcaaatgtgaacaattctgatatgccagagcatttgtattcttaactcatggggttattacaaagatcaaatgaaataatcattataaagcactttgtgcagtgcctggcacaaagcacgcactcaatacatgttaatgtttatacaattattattattgattgtcagaattatcagccccacatcagcaaagaatagtaggtggtctgtcagcaggaacatggaaacattctcattacatagaagtcagtgttgcagggacagtcattaaaacaggatctaattttagtcttctgagggaaaatgctaggttctccggaaatgttgaatccttcctcgagcatgtagtttaatttttcaaaattatattgcatatcctgtaaaatgaaaatgaaattgtactgctgttcattaaaggcccccaaaaatcttaggcactatacaatataaatgaaaaaaaaggcgttatttttccatagggcataattagaaataaagaagcaaggtcactcacaaatttccgagctataaaggaggaaaggaacaagattttcccccggttattttatagctgccaggttgaactcatacttatccaatgagccccagaatggaataccgttctacaccaactgtactgatgatagtgattcagggagtaaatgataagattccatccttctaaagtgcttttgggattggattctagtaagtttcattttgctattggccaatcacaaaagagactacaatagagaaaagtgaagacatcatgctgaagacagactgctgcatagaaaaggaagagggaccccctaatttagagatatggatggagaaaaaaaggcacttatgctgtagcataagggaaacattaaataaagctataatagaggagaaaatgtctttgaatagaagaaaaaaatcagacagacagaaatagactaaaatgctaaaaaaaaagatacaaaaggacattgaaggggacatacagtgattattacacaaattaaatgcacacagttaaaagggaggtgaaaagcttctaaaaagaatgagtgtgtagtgaacttaattttatcatctttactaagacaaagttaaagtccctaaaatattttaagacacttaaaaaaaaaagtcttaaaattttgagagcctttcagctctgtcaactctagactttccctcctacttaagttttttttcttttttttcttttatcttttttatttatttatttttttttttatgttttttttttttttttttttttttttgagagagagagagagtggatcagccttaataagagaatggtcttctgccaggtggtattctcctaatccctttccagtgagatccacaagggttcaaaaccactttctggggtcttagaggcaccacttatctctcttcctctgctcatatctttctgctccagtgcccgcatagtttgtgttatcagtggtgcgtagcctgagacatccacgacctatgccagctctcgaagtaatgtgattggcatccaaagaaacacaagaagcccatgatttcgtccctttgcaatttaaaatcatatttaaaatgccttttggtcatacaaatttgaaaatgatcttgtaaatcacttccgggaatctatggtcaaaactcagcttagagttctctacttcttaacagagtgcctgccggtaactagtgactgtcaatgagtttgaaaacataaattgatgtgcaaatgctagataatagcaacatcctgtgcaactgggcagcatttctgttgtttggcttttttattttcgtggactctcccaatctgagagaaaatagatttgagttcctttttaatcggtttagacccagacaaggatttaattggtttagaccccattcacctacgtgtgtcactctgtctccaacataacagaggagatgaccaagacaacatgctctccagccaggaggtggggaatactttggtgtcatagcagacaattattgatggaaaactcatgttagaaaatgtaaggtaccttcttctagacggagtaaaaggggcagctgcccagactttcattttaaatagggagcccatgatacaaatcttttaatacaattttaaaaagaagagacatagggggtatctcttaggacctgtcaacaaccaaccctctatcaaatggccaaatcacaggtggtctgcagcttagccaaaatgtccaagtacctttttgtaacacagaatctcctttgaagatccagctttcattaatgatccccagcagctctggtcaatgtgtcttttcacaaatgaagctttttaaaagctttcagtggacaaatgtggctttgagttttcaactaaatctttctgtttaaaaggagtgctgaaatgggcatactttataatcttaaatgctgcacacaaaatactgaaatattattgaccctgagaggttggttcaaatcaaatagcatactcacgtaaacgttctcttttcctaatattagcaacagggaatgtgaaatagagaggggcgggatatgctggataggggtgcaccaaaattttcaaaaagcctcgaaactagtgtatattgataaccttgtggcatctaatatctagtattctttttttttttttttttttgagatggggtctcgctctgtcgcccaggctggagtgcagtggtgtgatctcggctcactgcaacctccacctcccgggttcaagtgattctcctgcctcagcctcctgagtagctgggattacaggcgcccgccaccacgcctggctaattttttgtatttttagtacagacggggtttcaccgttagccaggatggcctcgatctcctaatctcgtgatctgcccgcctcggcctcccaaagtgctgggattacatgcgtgagccaccgcacccagcctagtattctatgtctattatttcttcataatgagactgggggaaatctttggagaattaatgccgcagttggtaaaatcattctataataatgggtaccattctgctctgtcccacatttttatgaagtctctttaaatttaaaaaggcaatgtgctttgtggttcttgagcaacttaaatacgttgctctgaatagttattgtgatgaggtaatttgtaacaacttttaggatcaatgctaattttcttaaatgtttctgtagtttcccctttattataaagtatattaggctggactcttggctgtaagtgacagaaaactcaactcagattagttaagaaacaaaagggtgttggtgacagtggtggctttcagactattgctgcaggcccacctgccatcctcttaacaccctcaacataccctgcagaaaagagagagctactctgacccgagagcttaaagactggtcaagtatgggcttgactctttatggcccaaattgggtcacatgcccacctaggctaggggaatggaatcgtggaattgattgattgattattgttgcaggttgagtcctccaagaagcagatgccagggcagatttattgcagaataacacctgtgaagaaataggggtggaagcagaattgaacaagggaagccatcagatcacaatgcagatcttctagactctgtgtcagcacaacaaggaatgccagagcaaagactgccaattagaggaatactgaattgggcagatctgacaatagtctgtatataactcgggactgttaacttctccttcctcaaccagttatagacatagaataggactctcttatctcaaacatcaatatctgtgtatatgaagtagagggtgaaagtttactgtacactagtggttctcaaccaagagcaagtctgtcccccaggggacatggcaatttctggagacattttcagttgtcccaactggtgaggaggtgctactggcatctagtgggtagaagttgtggatgctgctaggcattctctataattcgtgggatagatagcacaacaaaaaattgcccaggccaaaatgtcaataatgctgaagttgagaaaccttgctctataaagatacatgtcttggccgggcacggtggctcacgcctgtaatcccagtactttgggaggccgaggtgggcggatcacgagatcaggagatcaagaccatcctgggcaacatggtgaaactcatctctactaaaaatacaaaaattagccaggcgtggtggtgcatgcctgtagtcccagctactggggaggccgaggcaggagaatcgcttgaacccgggaagcggaagttgcagtgagccgagatggcgccactgcactccagcctggtgacagagcaagactctgtctcaaaaaaaaaaaaaaaaaaaaaaaaaaagatacatgtcttatgtgtactgaaagaggccacggaaaccttttgttgatacattcttgatagtttttgttcttatatgtagttatgaatacttgagattccatccaatttatttaacttttgaccagaaagggtagattgaattggtgaaacatctatatcctgaatatttaaaagattctgttttttaaaacaaatattaacttgaattaacgtaaatattcttagtagttaaagtccttaaagaccttagtttggtgaacagataagaatcatctgtgttcagcatatgcattgccttatgaagatggtaagtcaaaagtatgagtttatttctgatatttaaatatccctgaggtatagatttgtttactctggaagtttactctgttgtttgtttgtttgtttttgtttttgttttttgagacggtgtctcactctgtcacccaggctggagtgcagtggcacgatctcggctcactgcaagctccgcctccggggttcacgccattctcctgcctcaacctcccgagcagctgggactacaggtgcccgccaccatgcccggctaatttaatttttttgtgtttttactagagacggggtttcaccgtgttagccaggatggtctcgatctcctgacctcgtgatccaccagcctcggcctcccgaagtgctgggattacaggcctgagccaccgcacccggccttactctgttgttttatttcttcattatatattacaaagttgaatgttagggccaggttagatcggaaaacaagttaagtattccttatccaaaatgcttgggaccagaagtgttttggattttttatttttgtggattttggaatatttgcatattcctcatgagatatcttgggatgggacccaagcctaaacatgaaattcatttatatttcgtatataccttatacacataccctgaaggaaattttatacaatattttaaatacttttgtgcgtgaaacacaaaagttttgactgtgacctgtcacatgaggtcaggtgtgaaattttccacttgtgacgtcatgtcagtactcaaaaagtttcaaaatttggagcatttccgattactttggaaaagtctagaaaaagtttgatatcagtgcactgaaatcattttcaagtaggaacaatagcgatactagccctttactcatgcaaaattcacagtttttatctaaacaacacaaaatcattcaatgcttttatatttaatcatctatattcacctaaccataaaaaatcaatttcaatacagtaaggaaaagacaagaaaacgaatcattctaatcactgtattttgaaagttctttgcaaacaaccgtgaaatggttaaaagataggaggatggagaccagcctggccaacagggtgaaaccccatctcttctaaaaaatacaaaaattagccgggtgggttggcgcatgcctgtaatcccgggtactcgggaggctgaggcaggagaattgcttgaacctgggaggcaggggttgcaatgagctgagatcatgccactgcactccagactgggcaacagagcaggacgtctcaaaaaaaaaaaaaaaaaaaagatggtaagagaatgatgacttgttgcttactaaaataaaggaaagattgacactataagtgatactgtttgaaatctcaggaatctctgaatcattaagattatatcacaaatggcatgcaaaatacctgttcaaaaaatactcctcatggacatgagatgctaagctgctgatactgagtctgacctaggacaatgatgttctgtgtcacctcttttctgatgcctcccagattgctcctggcctcactgctgtctcacttccaaaaatacatattgcccttattggtcataacacagagactatcagttcaaaagtctctaattcgtctcagctgcagtcatctcccagcaagacacaaggttcttgagaaaagaaatttttcatgtcccatctttgccatccaccacacgatgaacatacagtacagtgtacatagcagcccttgaaaatgctggtggaatcattgattcttgaacccaactgtcatactttccagatttaagtcctggtaaatgattaaaatcgtatgggttaccctcaacaaaccagctcaagtatttactataaaaaagggaagctagatatggaacttcccctaaagatgggtctgtcaaactcaccccattgtattctgctctgacaccatgttttttgtttgtgttatttttttttaagagacagggtctcactatgttgcccaggctggtcttgaactcctgggttcaagtgatcctcccacttcagcctcccaggtcactgtgagagattacaggcttgcaccaccatgcccagccccaccttttaatacaaataagtaacagttaccatttactcagtgctcaccttataacagatgctgttaaacgctttacacgccttagctcatttttagttaaatacattgtttttgccccagctatggtagggatcttgctaacaatgagaatgaatgataagaggggctttaaggagaattcactgccacacctttcataattttcccatcattcctccagtctttgttcaaccgtccatgatttactgatttgctattacatcaaactatgctgcaacaaaccagtggttccttctgatttttatccatctcctcctcacctagggtgagagtctgaggcttccttgagtctactttctgatattgttacatttaacacagaacatctcttgttttcgtttctggcagcttatcctctcttcgctttctccatgctttcattcatcctaaaacaccattctgacaatgatatttaggttggtacataagtaattgtggttttaccattaccttcaatggcaaaaactgcgatcacatttgcaccaacgtaatatttttcttacttaaaaaattaatgtagagtatggaaatacttgccatcagggaatggggaagaaaatggctagagagacatggtgaaagagagacttgatttttaaataactttttttgtttttcttgaattttattatcatgtgaatgcatttgaaagaaatacaattttaaaataattattaaaaaaatatttgaatgccttcccatgaacaactaaatgaagtctctattcttaaacctgacagtcaagtacagctctggtttgactccaagctacatttctagccttgtattattcaactctttttctgtttatccttcatatccgggcctttactagtgccaaaaaaaaaaaaattgctcattctactcttgtcacccagagtgtttcttctgtttttgcccatcaaaagcttacccaattgtgaaggcccagtttcaaagcaacctccttcattaatttcatccagatactctgtaacccccatagctgtttaggcttgttctagcaatttgcagttatcagaaaaatgagtacataccgagtgccagaaagtggtctctccaactgtgcacattacaacatctcattctctgtgcctccatttcctcatctgtaaaatggtcactatggtgtactttcctcatagtgatgttcattctttcaagtagttagttaggtacctactatgagacaggcactgacctgggtcctgggggtacagtaatgaataaaatagattgagtcctgccctcatcaaatttaccttctgataagaaagacataaatgaaatatacctataatgctcttgaaatagcacttgggatatagtaaatgctctataaatgtttgctattattactgtcattgttggtagtgttgttatgtggtatttctattaacacataaagaaactaaggttcacaggctgttagataagatgctggttaaatagctagtaagggactccaactcaggtcttcctgagtcataaaattcgtggcatttccactacactgatggatgtataccaggctgtacatcagaactatctgtggagacttaaagaaagtaaagattctcaagcctcagcctcaaattaactaaatcagaaattatttagacgagctaagaatctgtatttttttgaaaagttctcaaatagttgtgatacactgtcaaattggggaatgactgcactacattaaaatctttcccataatactttattatgcttatttgtaaatatcaaatctacaaattcactaaagaccatccccttgttttcttatttatttttattttttctgcttcctctcctagcaaagtgccttataaacactcaataagtatttgagtaattaatggcttaattatttaaagttgcacttaaaatgcaaatactcacagctgtggtactggaagcctgttatgaacaatcatttatcttcctagggttatttactaatcagctaaggacaagcagttgggaaagaaaggctgactatttgggaacagaactgagaaggccctcaaaccaaatgttagccacgttattgaacagcctagggccccgccttaactttacctacacttcgttgacaatttcaggtaaaatgcagaaaatatacgctaacaatcaggagattcctccctcacaccattgtagtttcatttcttttaagccgacacatgtctctcttatggaaaatatgggaacaacctgttttaaagaaagaaaaagaatcctttattcttgtcacaccacaaacatggagttcactgctatacgttaagattataaagcaaaatcccaaaaacgcagtgactgattattcacagtagacatatgaagtcaggaagcttattttttctctctttgctaaggcacaaagcctggggctatatgcatttttattacactgtactgtgttgatttcacttgaggattaaaaagagagttgaggcacagtgcacgtatcttgatggattttaggatttcttgctttcgtgaaagaaagaagcttataaagtacctcagattatcgcccagggaagtgtacctacttccatgatgacctagaaattcaatcttttgtttctcctataaaagatcacattgtactttggatgttttccctgtagttttctgcactatgtaaagccacatttggaaaaacaaaatagttttagtttagagttgaagtgaaaatatctgaaatagttcaggaaagtcttatgagcatttggggagcttacaaacagccttgggggtggggtgagggggaatgagggaagagggaggcagggggagagaagaggagggctaggtcagaagtgtgcaaagaagacagagggagagagaccgtagagactgtgagtccatggcagagttttaattctggttctcacacatctacacagagaaacaatggaagcacattgctccatcccctgtcctttactaagaagcgtgaagtaaataacttgtggcttatgatatgcgaagaagagagaagacagaatgttgtaggatttggaagtacagtagatgagatcttccggtttattgatttgtaaagaacggcttgatactggtttgtcagttctgcatcagtgagagaaaagaaaggcgcttttcagtcacttgccagaggaggagagccgggaagtggaaacagggtcttctggcggacaagcttccttgagtggtggtcaaattgactgtgaagggagtcaaggtcaggaagctttggaaatgctgcaaggatggtacgggatttaaggagggttgatttcctcggttaagggttgttgcagacttcagcaaattcccccttccagcctttattaaagaagtgtttagtagaacaaactgaaaatctacaagtatattgttacccaaaatataaaagcttctgccactgagatgaaaatgtttgatttccagtgctttatctttttgcatttatctacctgtttcagtcattcgttaatatgaatttcctaatatatgccgtcttttttttttttttcggacaataccagttctatggtatctcactgatgattatttcaaattgccacttttgttccttggaaatactcctgtgttcaaataccaggaggcataattatgtaattaccatgtgaacattatgctacttatgggccaaaatgcccctagaaaggaatgctccaatggcctcagaaaatttctgtgagaacgatatcttccaaatgtggtataaataaagctcaagaataaatagctaaggctggaatgtaaatgatttaatgtaatgatgttgtaaggtgagagccacttgactttagttcctgttgcaaatcatgagatacattaggaaaacttttaaaagggaacctattttttaagataaaatctgtatcaagttacatcaccttccaggcaaagtaattcaactttcctcttttctctctgagaccaaaaaaaaaaaaaaaaaaaaaggcagaagaaatgcttcctatgatctcttctcttcctgtcacaattttcataagtctgtagatgtaattaaaactaaagattttgacaaatgaaacaggataggaggttgattgctgcttttctaaattaaaatgaatgatacccttaaggtacttgggtctatgaagtcaatttaatgttgatataacctgactccattatcacagaatgaggcagttgcataagcaagaaaaccaataaacaaacatccaaagtgcattttagaaatcggtgaggtgaaagattaaaggcttaacaacggacaaagagcttgctgttttgttctctcttgccttccagtttgatggcagagttcatcagaattagaggaagaatgttcttggagaagcgttgggctggcactaggctaggagtcctattcatatcctgcctcgcttgtcttgcaagcatgcacagccccttcatttgaggcactgtttgcctcagcagagtctgtgtactcttctggtaggttgtatagaacataataaagggggagggctggaggagaaaggacagaaaaaggagggaataaaaaaaggagtcagattaagaaagaagtcagcacagaaatataaaatggaaggaaaaaaagctgtgatgcaggaaccttaaaaggtagattaaggatggtctcagatggcacggcattagtatcaatgccataagtcacacaaaatctattaagaattatgctcctactcagagtgagtgccatgttagcactagttgtttcccgtgatctatcctgaagtcaaacgcaagaaacactgtttaactcctaagtgccctaatgtcaggaaaacacagaaataaactcaaaggaaagacaattcagttaatctttgcattcaacaagcccaggttgttttgccgcagagctatacctatcacaaaacttcattccagaagatggccggtagaggtggctcatgcctgtaatcccagcactctgggaggcccaggagagtttgaaatcaagaccagaacttatctcagactttttttttttttattattttttcagttacaactcaaaagaatcagaattagaataataatggattttaactgaaagggattaccattagttaaaaggattttaactgaaactgtaatcagtctcaggagcgtttcccggataatgtttgggcacgtatttatgagtgttacttgtgaggatttgggagtaagaatgaacgaggaagttcctcccccaacacagacacatgcacacagaaactgtacaaactgaaaaacttcaggacaaaaactcgtgaatagactggagagtcatttgtgtgcatatgtgtggtttatttactagcatcacagcacaagagtttctgtcttttgcttttgtttttgttttaataggctcatttgtgtaagtgtcatgtctgtttcttgcattcccatggatatttatctagggtctagacaaactgagaaccagaaaatcaaaacatacgttcctagttacatattttctctagactggagtaaacatgatttatgtatgtagtaatcagtaagatgtagcttggacactaggaagaaaccacattgcctagcagtgtatttccacatggggaggtaatgcctgtctctcctaaacttctagtgaagataaaactcaaagtagagtaattaacagaaaggtcaaaagacaaagtggaagcccttgagaatctaaaacaaagttaaagaaccaacatttacatttagataaatttatttgaaataatttctaagagccatgatgttgttatcggtcctttttctttctttcttttattcttttggcttatttaaaagcaatgttgaagaaaaaatgaaataaagcttatctttcacaatacacagaggaatggactgagctttgggaaacagtcacagcttggaattaagagtgtgtgtcgtatcgtaatttagttggatgatttggtgctcattcattatacccagaattacgctttcaagtctaccgtattcatacttatctcagtgcctgacaaataagaggaactcaaaaagcctttcattcattcatccattcagtatttcttgatcatcttctatgtactaggcattgtgataaattcttaacaagacagataagatctctgtctttgtggacaataaacttacattctagtcaatatcttttgaatgaatgtagtgatatttcttactgaagctaagaaaggaaggtctctgcaaacagtatactgtctacagaactcatctgaaatgagaagaccaaggagaataatatatagccctcataactctcaaatcttaaatatgattatttaaaaactagagtaaaacaaatgtggaggagatttggacttcagggttgttttataaattgccgttttacatttttaaatctagtattataggcaaaattgaatctaaatggttttcttcttttcttttttttactttcatcatcaaaaatggaagaaaggaagaaaaggaggaaggaagaaaagaaggaaaggaagaagggagggagggaagtttttcaaaagcttgtgtcagggatcttgaaaaagaaatgattcattcaaaatatagttgttaatagtaaagatccgtgaataaacagtacattaattcattcaactaatattaatttagcacctattatatgccaggtactgtgctactcactgaggatttagcagggaaagatgtgtccctgtcctcatggaacatataaaaaaggacctttttttcctgagatgcttttactgaagaattgctgcaacctagattatgagttctcatggaccagatggcagttttctgcccatctgggatagttctgaagaatagaccctcgtgtatcaatcaaggtttcttccagttctaagctttcgtgatctatgatctaatagttgaaacaggatgtatgcttccaaaaagatgttatatttgtattacttttataaaaggaaacagagacatgccctattaattcagaagagattgggttcctcctggctgtttaaatcattctatttaaactcctttatctcttctttcttggctcaccttccaaagctcactcttaccccttttagtctcacttccctttcctttctttaattgctgagacaaattgttcatctctaactggctatacatgacatctccagttaaatgtttcactgttaggacaaattcattatgttccaaatgaattcatacatacatatgctatttcttccttttctgattttcatattgccaccagcaatatcttcattctcccagtcttccttactcgaaatccaagagtttatttgcttcttcagatattaatctccaacaccaaattggatagttcttcctcctttcaaaataccttctcatatgtaccttcttttacattgaatacaatacagccttaattctaatgcatatcaacccaagtctagtaagttacaacagcctctttctgatctcagtctcaggtgccctttcgaatctgttttacactatactgatcttcccaaaccctaactttcctctaaaatagtgagtcatgtcacagaaattttcagtggttctctttgcctgcagggtaaatcttgagcctcagagtctgggacgccttgctttgcatcatcggctttcaacatgactaactaattgtatctcactgtcgtcctcaacaccactgttctgcagccccaagcctttcttcagcttgtcactacttcttacctccaaacctttacacttgcagagatcagggactatagcatttgttttttgcctatctctttcaatattaacaaatacttataaaatgaataaaccaccaaggaaagaactgattgtgccagaacataagacacaggtatatcatttctggcttttgcttcctgttttgtatataccacggtatattgatttaacatacagccagttagaaagatctaatgcatggaggctctcgtttaatagattatcaaatttcatttccttgcataattgctcaaagaataaagtgctttgttcctaagtcccaagctaaagctttcgaggactttggttgctttcaagtttttctcattcataaatttgtttctttatttagccagttgtgcattcaatccacacaaaacctttctccagtgataatttgtggaaagaaatattttatgcttaattcttctcgctgtcataccttctcttaagtttgagttatgaagatggaaattcactttgatctcattttaaaatcttgacaatattgaatgtacactggaaactaccactggagcgctccttgtataagaaggcaaaattcttcagagagaagattgggagtctagaatgaactttgatgctgcatcggctcagtccctatgaaactaacattcttactagagaaagtggcctatggcacagtcataatcctttaccatctacatcttccccttgggatttctttctcagtatgtgcaaagatttctgatcagtgtccactcccatatggcatcttcatcttctcctctctacccccaaacactcacatttatctctagattgatttattcatgaaatgacccattctaaatttagaaataatgacatatgcccaacatttatttgcacgcgttttcccacaacctttctctataatcttatggtatcacattcttcaagaccaggaattgaccttgcattgggccataaaatacgttgaacaactgcagtttcatcgatatgcacactagaattggtctgcattcaataaactgattaaagaaattaaaaagccaattacttattaaatatttataaaatactttttttcaactttaatcttcaggatagcagttaagagcaagacccagactgaatgagtttgaatcctagctctgccaatttactaactactgaagcttaggcaagttttttttttttaacctctcatgcctcagtttttatgtcaatgaagtcggggggaataatattaactcctattgcagagttactgtgaagatgaaataacataattcatattgtcatgccacatattgcttaataaacattagccatttttgtattgtatgtggtgccctgcacattatagtctattgctctccttttttgctttttttttttttttttttgagatggagtcttgttctgttacctaggctggagtgtagtgacacgatctcggcgcactgcaacctccacctctcagattcaagtgattctcctgtctcagcttcccgagtagctgggattacagatgcccaccaccacaccaagctaatttttgtatttttagtagagactgcgtttcatcatgttggccagaccggtctcgaactcctgacctcaagtgatccgcctgcctcggcctcccaaagtgctgggattacaggtgtgagtcaccatgcctggcctattcctctccttttattaaccataatagtagcaagaacagtagctggtaacatttattgagcaattaccacgtgacagaaactaggctaaatgctttacattgtatcatcttatttaattcccacaaaaccctataagttatattattttccacattttactgataaggaaagttaagaataatttacccagggacattgattagtcaaggttctccagagaaatagaagcaacaatatacatatgtatgtatgtatgtatatgtgtgtgtgtgtgtgtgtgtatatatgtatgtctatgtgtgtgtgaatatataaaattaagtattatctcatgcagttggagactaagaagtcccatgacctgctatctgcaagctagagagccaggaaaattggtagtgtgatttcagtcccagtctgaaggcctgagaaccaggggagttgatgatgtaaatcccagtgcaagtgcaggagaagactgacatcccagctcaagcaggcctgcagggaaaaaaggaacatgcctttttgttctgtttaggacctcaactgacaggatgatgcccgcccacattggggagggcaatctactgaatccactgaaccaaatgctaatcttgtctgcaaaacaccctcacagacacacccagaaatagtggtttacctgggcaccccatagtccagtcaacttgacacatagaattaaccattacagacctgcagtcagtgcactcagtgtcagtaggcatacttgtttgttccgcatcgcttctcttctcttctctctctctctctctctctctctctcacacacacacacacacacacacacacacacacacacacacgtaccacatttactcatttactcatccatttgtttggtcaactagtcattaaacaaatatttgctaccatatactatgtgcctcctgcagaaagggttggagacattcgaagagaaaggtaaacaaaaaatggtccctgctatcaagaagtttccaatctattgcaagacacactcatgtccatataactaaaatgaattatatgatagaagtgcttcaggtataaaccatatactgttagaatgctgaggaagccattaattctaacctgggagatgaggaagtaaacatataaacactaacagcattgatctgggagagaagtggggtaagagcattgccgagagaaggagcagcatgaagaagccacgcacaagagttatattggatggaatagtgcaggacaggcaggtagttttggtgggcttagcaggtagagtttgggagtgcagggtcataaggttgggaaggtaggtttgatatgtccctcatgcttttgtgtatataaaataaagtaaatcctgcattgtaggggaaccccacttggttatccacgtatttgggccaagcaaaaatgggcaagtctagggagagagtgaaaaaatgagattgttctggatatacactaggcacttaattgatattggaaggccagagttggtttgagaccaggctacctgagccacttttctgatgagattaacatcgatttttacctctcgggaattctgcacaccacgggaactaccccctgagttctgattgctctgtgcaagctctgatcaacccctagtttagcatggactgttcacaactaaatcaaaatccagagttagagagctaggatgcctggagccaccacttatattggattggcaaaatgccaaataagtaagtatagcatgtcacccgtaaaattattcctttcttccccaccaagaatagaactcactaagttgacagcacactgtgtcaatatattatagaaaaacctaataggaagaaaagaatggcagttttcactgcatgccccctaaaggtatatttcttaataatttccaagtccactgaaaactgaattccgaaaattagttttatcttactacccaccctattttatcccaaatttaagccttgcctgtacttctttgatacttaatatttttttctttgaggtggagtttcactctgtcacccaggctggagtacagtggcgtgatctctgctcactgcagcctccctcctgcctcagcctccctaggagctgggactacaggcatgcgccaccacacctgactaatttttgtatttctagtagagacgggttttcaccatgttggccaggctggcctcgaacttatgacctcaagtgatccagccaacttggcctcccaaagtgctgggattacaggcatgagtcactgtgcccagcccataattaaatattaatcaaccactggttaattaataattatcaataattaaatatcactcaatgatttattatctattaatcaatattgcttctttaaaaatttgtcaaaaacaatagcctaagacttaaagacaagacatgtcatttctgagattctgtagtcacctataccaaatgtcaccctccctaatgtttttgtgaaagtaaagatttgtatttttttatggtactaattgaagcagtagttcatttgtggctgccaatgagttgactgtaaaaaaaaaccaaaatctcattttaacattgtcgagagaggaaatcctttgtgtttggccttggattgataaaaacgagtctggaatactatatacggtaagtgaatattaaaactagagttatgaaatgttgctttagtgttctcagtcttggagactcaaagtatcttatcagaaaggatacattgttttaattgttcctcattatatagaatgagagaacatcatttctctccttttcctcccaggtggccgtcgaggaccgagtcaggcagctgcatgaagcccacagggactttggtccagcatctcagcactttctttccagtaagtcattttcagcttttatcacttaactttattgcatcttgattaataagaataacagttgaaaaaacaaaagaattaagagttgaattatagtaatcttttatcagatgcagtagaagcataaatcatcctgaaatataacttggttgataagttgagaaggttaggaagaggaaggccaattggatcattttgtccagtcttcagctaatgcataattgtttcctgcactatattctcaaatgttaaccatattaatatttttgagtctttttgaaaaatgtggaacactttgctcaggagccatgctagtattctctgtatcattattccaatgttagtatatgggctgctgaagcaaaaacatacttttgagtttttaatttctgcctatcagttcagttcataaagctaataattatgatatcatgtaattataatatgatcatccaatatatgttactgtgactctataattctttaaataattcattaaatgatccctgccttatgaaatgagtgacaattctcaaaagaaggcatacaaatggccaacaggtatatgaaaaaatgctcaacatcactaatcaccagggaaatgcaaatcaagaccacatgatatatcgtcttaccccaattagaatggctattattcaaaagacaaaaaataacagattctggtgagaatgtgaagaaagggaactcttttacagtgttgatgaaaatgtaacagtaaattagtaacagtatgaagattctcaacaaactgtaaatagaactaccttaccatctggcaatcccactactggttatccatcccaaagctaagaaatcagtatatcaaaagggtacctgcacttgcatgcttatcacagcactgtttaaaacagcaaagatgtgaaatcaacctaagtgtatatcaacagatgaatggataaagaatatgtggtatctgtacacaatgaaacactgcaagaatgaaaccatgtcattcacagcaacatggatggaactggaggtcattatgttaagtgaaataaccctggcacagaaagacaaaaatcgcatgttcttactcttgtgggagctaaaaaaattgataataaacatagaatagaatgatagatactagtggctgggaaaggtgtgtgggtagagggggagataaagagagggtggttaatgggtacaaacatccagttagatagaaggactacgttatatcatttgacagcagaatagagtgactgtagttaacaacgatgtgttgtatatttcaaagtaccaagaagaaagggcttgaattgttcccaatacatagacaaatgacaaatactcaaagtaatggatgcctcaaataccctgacttgatcattatgcattctatgccagtaaaatatcacattacctcataaatatgtaaaatattatatatcaataataaataaatactatgcctccaagttgaaacctcagcctatgggcatttcctttccctaactgtttgcatccttcctttttttttttttttttttttttttttttttttttgagagggagcctcattctgtcacccaggctgtgagtgcagtggcgtgatcttggctcactgcaacctccgcctcccgggttcaaactattctcctgcctcagcctcccgagtagctgggactacaggtgtacaccaccaggcccagataatttttgtatttttttagtagagacgaggcttcaccacattggtcaggctggtctcgagctcctgacctcaagtgatccactcgccttggcctcccaaagtgctaggattacattcgtgagccttgtattctccttttgttcttgacctctagccattctttttatttactggttttgctattttattaattatgtttttataattaatactaagagaaataaccttggttaactgaaagtttaagtattagaaaatcctatttatacaatattgcatattaaattggcaagcacctgttttcctctgattaatgttaatttataccactttttatttgattataaaagtatatgtgttgagttttttggtatttaaaaagccatactttaccacatggagttaacatctgttagcattctgatgtatttccttgtggtcatatatgagtatatatgagggtttatccatcattttaacgcaattactttgtgcctagaaatgttacagattttaactagtttaatccttatagcaatcccttcaatcccttaaggtaggtaccattattatacccatttcaatgatgaagaaactgaggcacacattcatacagctagtagatgagggagccaggattgaaactcaagaagttggctccagagtctgtgtttttaagcatcgcactgtaattttacttaatttatatattttatagagaggaagtaattctgtatgatctccattcttctgccatattctttcattgccattttctgatcatttcctttcttttccattctccacgggttaataaaaagatccacgctcacaaatactttaaagtatttgagtagatgttgtcatgtgtgtctccagttggctgttgtctttttgaacaaaatttcctggaaggtgttggtcctgtgtttttgtcatacatcgataatagattaagaagaagtatcttattttctggactggctctaactttattatccgcatgtggtctagttatttggacacagtttcacaatgctttggagttgccaagaaaaagggataagttaaagcagtttatctaaatgagtgggatcgtggcttttaggaacggctctagaaaaatgataaaggctacagatttcgtcttctgcatctttccaaatctctggtctacttaacttgccttggtgacagccattctattcgatttaattgagattaaatgtgataacatactcctaagcgactcataaaccataaataaaaaatagtactattatgaatattaattactcctcagacaccaggtatattcattcatattttcttctccctgactccccctctgaattcccatgtcttacccattaaaacctattttcagaaaatgatatactcatttaacccaagtgataggtaaagtttaatgtgtacttctcctgggttatttgcattttattagtgtgaaaatccataagcctgaggtggtagaacatcggccataagctctgagctgtgaggaaggaactttgaggggccaaggggagcattctcacacctttcaaaccatatcacatcagtgcccacttccagaaaggtcaggcctgttagacacaggtattcataaagagactgatctacctgcctgaatggagccagccccggaagtcatcagtctcttggatgcccatgtggaatatcaatatacgcttaaaagctttgcttgcaggtataaagaaaataccaacttggtttaagggatatttaagaaataggacggtgagactaaggatggattgtttctttacattgtactttttaaaattacaaaggtactctatacacatcaagaaaaatttggaaagcccacagtacaaacaagaaaagaaaaagtatccataatcctatgactcagagataatcactatcagaaatttggtttatatactttctgtatttctcttgtggttgcgtgtgtgtgtgtgtgtgtgtatcaaggttctatcttttatttttttatttttttgttttttgagacagagtgcaatctcagctcactgcaacctcccccgtcctgggttctagcgattctcatgactcagcctcccgagtagctgggattacaggaatacgccaccacgcttggctaattttttgtatttttagtagagacggggtttcactatgttggccaggctggtctcgaacttgtggcctcaagtaatccacccactgaggcctcccaaagtgttgagattacaggcatgagccaccacgcccggcctctctcttttcttttaaaccatgcgcagataaaaacatgctacagttttatgagctgcttttttcccttaaaactatctttccaatattttcgtgtgtttaaatattcttcttcagagtaatttttctaatgactggctaatactctcttctgtggctgtaccaaatttaccaacacaattctaaattgctcaatataaagattatttcacaatctttattatatcgagcattatggctaatatcctttttatacctttacaaatatctcagattctttctacaggataaatgcctaaaggtggaattgtcatgttaaagaatgtttacattcgtaagccttttcaagtgtattgccaaacttacctctagaaaattgcaccagaaattgggtgtgccatccaaaccgtatttgagctaggcatggtgtggctcatgcctataatcccaattctttgggaaactgaggcaggaggatcacttgagcccaagaggtcaaggctgcagtgatccataatccacccccccccgcactccaatctgtgtgacagagcaagaccctgaccctaaatttaaaaaaaaaaaaaaaatcaccatatttgaagcaggacatctctgaagtcacgtatttgctactataaaagcagcttccccccaccaatgaataaaaatatgttttaaatattcctctaaggtcatattaaatgaatttgaattgatacttttttttagacaggcctgagttgatacatgtttagtaatgtgctttcaggttactataaataataatagggtggctcctaaagcttagaaattacaaagaaaagaaaaataaggaggaactactaattgcacccgccagcgtaaacatgcttactgtctctgtttatcttattctctctctctctctgtctcgcacgtgtgtgcactctctctctctctctctctcacacacacacacacacacacacacacacacacacactcccctttggaaattatttggaaattacattaccagctgtctgttgtttatcagaagacagaggcagccttttactaaaaaaaagaattcactgtttcttcctggtggcccaatctctacatgttaaagaaattttttcttttatcttagatctaagagaaaatgagaagagaaaagcattgtgaaatatgacccttctccgctgatagacactaacttgtccttacttctagttttaatacactgctactcctaattgacttctacaacttaaaccaagaaaaaggagaaattctaatagtgtgacttcaaatatgtatataatttacaataaaattatcatttaaattatttaaattatatactaatttatagttatatatgtataattggtaggtatattgtcagtctcttcatatgtctgtgattaagaaagtactaaagtattcattggttggcatagtagtctgaaaattgtccttttcttttgaagagtttaaagatttgttgggcgtggtggctcacacctgtaatcccatcactttgggaggctgaggtgggcagatcacttgaggtcaggagttcaagaccagcctggccaacctggtgaaacccccatctgtactaaaaatacaaaaattagctgggcgtggtggcactcgcctgtaatcccagctgcttaggaggctgaggcaggagaatggcttgaaccctggaggtggaggttgcagtgagctgagatcatgccactgcagtccagcctgggtgatagagagagactctgtctcaaaaaaagaatttaaagatttttcctgaccattatttcaattctctggtcttctgttctaaattctacttttctcaccaagaaagatcactatatatttgggtaaagggagaaatcattctataacagtaaaaagaatccatggttttcttaatattttacaagttccagaggtcccttaaaagaatattttccaagccaggttctttaaaacattaatgttatattaggttttgataactgtcccttgaaaaaaatagtactgattaataagattggaaaaacactaggtttcaaagataagcaagtttatttcttgttagaattcttggaatttttattatacactgagactctaagaggataaggagtctatagttctccagttttaggtgactgtggaagcctttttcaggcacaccagttaatttcacactaaactttatgccatggatcacagtgaatctttgccttaatgtggtatttgccagatgctttaatgacaaaaaatttctgctaaaggttgtagaaacgtgatccaattaaaaagaaaatgagtatttatgaggcaaaagggtcaagtccctctctttactgaagttcccagccccactcccacccaggagccctcttgtgctgtggagtttcctaactggagataagcttagaaagtatctataccagtagtttccaaactctgaggtgtggctcattagcaaatcctaaaatcagtttaatgacttacaaccaacaatttttgactggtatggaatggaatggaatggaacagattagaaaatatcagagtgcattacctaagcaaggttaagtgttgttttggcggtggttaatttgttagatatgtgtgtacatgcgtgtgtgtgtgtgtgtgtgtgtgtgtgtgcgcgcgcgcacgcacgcgcgcacgccagatcacagtgtaaaacgtttttcttctgtgggttgcagtcgaaatagtttgagaaacattgaatcattcgagccctttccttattttacagataatgaaataggtgcagaacgatcaaatgacataaccaaggtcacaaagatagttataatactgggactggaacccagtttctggacatccaagccacacatcacactgccttacccgttaagaagaaatgcccaggccaataactgtctagtctatctgctattgccaacgattattctctcgtatattcctcttcgtttggccatcctaagttgatttacataacctaaatttttctctcaacacctctgggctaaaaactgccttatcaaaatggtatcgatagcggttaagagtaaaagctgtaaaatgaaactgactgggttcaaatattgactcagacactttatgcttttttctttctctttattcttcatctttaaaatagggataatagtaacatatttggtcaattgtaagacacacttttccacccacgtttcaacagttctgaaatcagaatgcaccatacgaccaatgggatattgaattcggtgaaatatggctgtattatttcatagggttacagtgaagatcaaacagttaatatttgtaaaacccttagagtagtgcctggaacatagtaagtgctattcaagtgtttgctattagctttagcattagtatcattattactatcagcttgatagtataacttaatgcatgcctgttagagtcaaactagtcatgaaagtttcattcattctcttgcatttaatggtcagtataagtagttcctctcctttctgaagatgatttccaaggatctaatctgaaagtccagtgttttgcacattagaacggctcaatagttgtttgtataactaacgagtgataaataatcaaaaagatagaccttaatctctaaaatgtcaggatagtattagtcttgttgacagttatattctacagtacctaatgtggtatgtggtacttggtagatgttcagtaaatatttacagaatgaattatgtcttatacccaaaagaagaagaggtaaattcactcttgacattgataatacacagaggcatgagatttagcatagtggctatcacatagtagacactcaataaataatgtgaccttttctgttgcttctcagcaaagactaatagcattcataactttatatggtcgtttttatcaaagtcgactgtaccatgtaatacattaagggaaaaggctgacttcaaaattacagcatgatcacaactatattacaaaataaaataaaaataacagaaatgtacacataaaggaaaaatggaaaataaaaagataccaaaagacaaacagttattgcatcatttctttctttttacttttacaaattttctggtaatagcatgtactacctttgtaatggaaaaaaaacaataaaggtaacattttatactccagcttttaaccagtgacctcttgcagtggcaatgggactctgaaagacaaatttcctttttactatttattctgaatttaaaagctgtttcattgagtgaccttctcagattatgagacactgtaaaaagaaataactgatccattatttcttgcaggctttacaatcttaactgccttaatcatatccctggttaagtctttttctctcttgtcaaagtgactcaagcttttacagtttctccttgatacatagggcctagcagtttgtttctatcttgagagttgccaagctttcatcctggacattccccactacacatacacacttaattttaaaaaataggggaaacctttaagcacatctaataattgctgacatttcacttaacagtgctccaacctatgctaccagtgtcctcaggggacagacaatttgaaatatgagtggggcaataatttaaagcttcagattggcttaaataagccatcatgaggccgggtgcggtggctcacgccagtaatcccagcactttgggaggccgaggcgggcagatcacctgaggtcaggagttcaagaccagcctgaccaacatggagaaaccctgtctctactaaaaatacaaaattagctgggcgtggtggcatgcatctgtaatcccagctactcgagaggctgaggcaggagaatcacttgaacccaggaggcagaggttgcagtgagccgagattgcgccattgcactccagcctgggcaacaagagtgaaactgcatctcaaaaaaataaaaacatcaaaataagccatcatgataaaagtcagaaagaattttgcaggtccaatgtgagatgatttgcaggctaaaattctctttcaagtaaaatctcagggtgaaatgatttgagccagtttcttcagcagtcacatgttgtcccaagtgttaggaatttgggacaaatgccatgtgacctaccagtgatgctgataatgcccctataaattcaaagacagcctttccaatgcccataaaaagcagctacagcagtaataattatattctcttcttaaaatgtgttgtcatggcccttttctcctttagctcaaatgtatactccccaataagctctcagatttatttgctttacagtatcattagcaaccagattttgcatcgttggccctatatatcccatcaatttgaacacatgaggaaacagaacgtttttgtttctgctatgggaatttctgtgctggggctggcttacaatggctcaagagagccaattgtaaaatatacaggaattgtgagctagttattaagcctacctttggtagcttgaaatcaggcatagtgggaagatttactccatggaaattggcaaatactacaaattggggcactttgttttttttttttttttttttttgtgcatagatggtttcccagaaatgactaatttatctatgttatttggatcactcaagtccctgtaggcaaagaatcttcataaacttagcaggaaggatgctcaggatccaaatatttatgtgcgttgcagagtgaccactcatcctggtttgtctgggactttcccggatttagcactggaattcccattttccaggaaatctctgtagtcccaggcaaaccaagatagttgctcaccctagccttaggtaaaatccctagaagtagagccctatttagatagatggggcttcttgtagaagtaatttgttcaggtgaaagggagtgagggaagcaggataaagtaagaaggatgctggtcaaggagttaagtgggaaggaagagactcacttcagcttgatcccacagggagctctggagaacaaattgtccctactttgagataaggggcctgggctttttgtttgtttgttttgagatggagtcttgttctgtcacccaaactggagtgcaatggcgtgatcttggctcactgcaacctccgcctcccaggttcaagctattctcctgcctcagcctcccgagtagctgggactaccgcgcctggatttttttttttttttttttttttgtatttttactagagacggggtttcactaggttggccaggctggtctcgaactcctgatctcctgatccgcctgcctcggtctccaaaagtgctgggattacaggcgtgagccaccgcgcccagccagggctgggcttttattttcccgtgtgaattagtcattggctgtggatttctggggagtaggagatagcaaagcagttcccatttggccaagggaggatttctggtgaaaggaccaatgaggccttagcaaccaacactcacaacaactgcggctgggtgaaccagctcagtaaaagggatctgagtggaacaacaatagtattaacctctcctagactttatgaagctgctatcataccccatgcataatctggctttagagctgaatgggcgcatttagctggatcactaaccaccactccttcgtcacggacttacatggaaattagcccggtggcatggaagagatgagacaaatgtctgtttctttcttatttcatcttcctcattgtgacagattcttctgggcctcatgaggagctagggccaagagaccagcaccagagttctgaatcagttttataacatgggcactattttggtggaatgctggctctgaagggtgtatttttacactacccagaaaatgaaggcatttgtgaatttggcctggggtagcattttgtcatctgtccaaaatacaaagctttgcacaacagaaatagtgggatcacatccctgtgggcaagaatcattactttcgtttttccatttggatgttttccattttcagaacacaaccagtttgggattacaaagtactttctggtgagaactttgaagtgaggacaaaaggcattttgttctttagtagacttacataaactgttcctggtttaaaaaccattctagatttttaaatagactttcagatatctgcagtaaaaatcatcttgatttcaggcgactgcaggtactgctctgttatgtgctatgtctccttaaggctgtaagggacagggataggcttaggtgataaggaacattttcaggatacagagaggcatgaagaataacatgggccgggcgcggtggctcacacctataatcccagcactttgggaggctgaggcgggcggatcacgaggtcaggagttggagaccaacctggccaacatggtgaaaccctgtctctactaaagacacaaaaaattagccaggcatggtggcgcacacctgtaatcccagctactcaggaggctgaggcaggagaatcgcttgaacccaggagacggaggttgcagtgagccaagatcacaccattgcacaccagcctaggcaacagggcgagactccatctcaaaaaaaaaaaaaaagaaagaaagaaaagaataacatggaacaacagacaccacgaaacatgtttgcttctttctgtatatgcatttgctgccatagacttcagactattacagtatcatatcttctctcttctctccacctaacaccttctacttatagtttctactttcttatgacttccattttcttcctttgttatccgactttttaaacttccccacccatctgtcatctctgtttatctctgtgtattacattcaagctctccaagacaaagcatctgattggattagttatttattatccatctaagggtaatgccatctcacaggccacaggccagactgtaaactaggctttcttgacctgggcactattggcatttggggccagataattagtggaatgctggctctgaaaagtgtatttttacactactcagaaaatgaaggcatttgtgagtttggcctggggtagcattttgtcatctgtcctagaatacaaagctttgcgcaacagaaatggtgggatcacacctctgtgggcaaaaattattgggggctgtcctgtgcattatctctggcctctactcactacatgccagtagcactcccctcccttagctgtgacaaccaaaaatgtctccagacattgtctgtctgatgtcccctgttgggtgaaattgcccctagttgagaatcactcctttataccaatgcctgcacaatttgtggtaatgaaagtcatgtggaacactaaatacagtgacctatgcctgaggaattatttgaagttgcttttctgcatccttagggaccctttagtctctcgatgaaagggagtgtcctcagcagacaatcttcaggaattgcatcagctgcctcacccaagatcataccccttacaggggcagctcttcctgatcagtgtaggggaataatgacctggccattttggcccaactcaggagaacattaacattctagctcaagagctcccatggggttgaatgagactgtcactgggtctgcattcaccttgacttctccctatttctattcctgtttctttcacttcccttccacagttgtctatcctgctctctaatcattgccttagagttggcttcctggaggaagccaatctgtgagggggcaatgaaattgacaggcatttagaagcatctaagaaaaaggtattataataggcccattacagtcactgggtaatttgatttactcttgctttcataatgaggttgattattttgttcaggataagtagtgattattattatttaaggtgtccaacctcatgatctccattaataggtaaggactttggggacagcataaaattacatgaatctcttaccttaaaccttaagctcagcagcatacatgcccatgacaggcaagagttagaacgtaagatggtcagtaacatagatcttgaaaggaaatatgttggagtgtgagcactttaagggcatagggcctgcattacttttttattaaaaataattttgcatctaacacaacatcttgcatattagatgcaggatatgccttgattgaatgaataactgggcacttaaaagattgttcccagtctaataaaatgaaagaacttagcctggtgcttagtctaatgtccagaaagagttaatgaacttcactttatcttcagtcagttaagaattgattcactttgttactcaacaaatgtctgttgaatgaccaatgtaaatcaaactctgatctaggaactggggaaacggcagtaaataaaacaaagtttatttattgtggagcttacattttaacaagagaagatggacaatcaggtcatgataagtttgatttaaaaacaaagaataaagcaggctaaaggggctagaggatgggagaaggggacccttttagtggagtggtcaggaatggtgacatttcagtagagatgtgaggaagtacaccagtcagatattgggggacaaagtgttccaggtggaggaaacagtaaaagtaaaggatccaagatggagcatgcttagagggtttgagaaatattaatagcaaggaagccagtatgactgaagccaaggaagaaagatggtgaatgataggaggtcagtgagtgaccaagggccagacgaggaagggtcttatcaactatggttggctatcgttaaaagcctttggcatatatgctttgtgagaagggaagtcatagaattctgagctaagaagtgacatggtgcctgtagcattgttacttactgtgcctgtagtattcattcattcattcctatatttattaacaaaaacgagtcacctgaaatatgaagataaaaagagaattattgccttgggacatttaaataccaatcacaaaagacagacctataaaaaatgacctcctacagtggtagtaaatagtgggtgcaatgggagtagaatggaagggaggaatccattccacagtgagagaaaggagatgttctatctagttgagtattaacgcatattgtccctgaggctacatgcaaatccaaagtagagggtattccttttgataggaacttagcaaagaatgtttataattgcttggtccctgatctcacctagcaagagtcacaagatgcattcagtgatgaaaaatcagtttctcccttctacttagccattctgataagatgaatatctcgggccgggcgcggtggctcacgcctgtgatcccagcactttgggaggccaaggtgggtggatcacctgaggtcaggagttcaagaccagcctgaccaacatggtgaaaccccgtctctactgaaaaatacaaaagttagctgggcatggtgacaggcacctgtaatcccagctacttgggaggctgaggcaggagaattgcttgaacccaggaggcggaggttgcagtgagccgagatcgcgccattgcgctccagcctgggtgacggagcaagactctgtatccaaaaaaaaaaaaaaagatgaatatctccctttccagtttcgtgtgtagtctccttaccgcccttctgttcagaaaagggatttcttacgtatgtataatgaatataaatataggttttagagagcactaatgttttaatgagatagaaataggcagacgagagagaataattgaaggattagtcaacatgagggcaatttgatagggaaagaaaaagtctgagcaggaaatgtctgtggaaaaaaaaaatcgaagaggaatggaatgaaatgagctcatttatggtgtgagttagggacagaagggatttattctcaggaggtgaaaagtgaaggagttcatgttatagaattcgacctagaccagctatcaagggaaagaaagtaattcaaaagacttggtccaggagatctggagcagatacatctattagaggaagattcagttttgaactgcatcttcagttattcctggaacccaacacaaaagctcatgacaaccttgttatcttcaggcaaaaaaaaaaaaaaaaaaaaaaaaaaggcgggggcagcaaggcttatgtcttaaacaagacagcacataacttcaggtcagagaattccattaacatgaatcacccacaccaatttaaataggaaaaaaaatagtaagcttggttatgtaaaaatttagtttaaaaatcagaaccaacaattgaaattaaacaagaatgttttatttatttctaaaaatatttagctatttattttgaattctgaagcaatactaatatagtatataatgataaaacacagttgattttcatagtaaacatcagcatcagaatgccaagaggaagatttgtctccgttcatgttttattactctgagaaccgcgtaacattttttaaagagtcagaaaatggctagaaaaagaggaagaaagattatttccttaactagttccctggtcccatgctttggtggttaacagtcagtttaactctagaaccatggaaagtctctgtcactttcctggttaccctgggattcctcacattggcagtaagttcgtgaatgagataaatatcctgataactagctacattaatgatgaaaataattataaacgtaggagttggaatttttaaaaagtatcgagcgctctgtgctcttaacacagaggaagcattttgcatagattaacccgtttaatcctcacaccaacctttaaaataaggactgttattgtctccatttcacagaagagaaaactgagactagaacaatttactaacatattcaagttcatacttgtaactattatggattatcagccttagaaaaggggttccagacaccagtgaatagcaacccacacgtctcaactgcacagaccaaagaggatgataatccccattaatctttgcatgttagtagaggcagtggctagtaacaaatgggagagactttggctggaggatattttttattctttaatctttatgatactgtttcccctctccccttctctctctactcctctctctgtcagctgtatccacaataatgccacaatataactactatacaagaatataaagcttctgttctcatgcttatgggtctacaggtcaactgtaattcgggtgatctggataaaacttgactggaaagctctacttcatactgaagcatgcctgggttcgcctctaggctgtgagttcagtttagatggtttctaaatgtgttgggttgtgagccccagactaaaggatcagaagcaacctggggcatgttctcatggcagattgccagtgtgacaagcctctgttcacatcatatctgctaaagcaagtcacatggtcaagcaagccaaggtcaaggagctaggaagcacactgcgctcaccatgaggccatggctaaggtatacatgtttagttctttcacaactgagtgaaaaatgggccccaaattcaatctctcctatactctttttgcgttaattgctagttctttctcactcttctcgctttctaatggatgtacatcccatctatgatcatttggtttttaatatctgagttgctccctactgtctcaggtttcaaattttactttccttgaaatttccctggtgcctaatacaatacctttcacacagagagcgttcagcaaatggtgtggactgcctgtcgtcttttaaaagtacatctgcagagacagtaaaggcacctggcgatattgcattgacttgttagtaacctgacttaacccagatggcccaaagactgtaaccaccattacctggaggaaagttccctggtaatgcagtcagccaattatgttcgaatttactcgaaaattccttgagcataaattattcatggctctatttatgtaggtatctatcttcctatatctgaccttaggaagcttgattgctttcttactcttctaataatcaccgtgatgtttttgaagttttctataagtcggttagaagcagcttttttttctttttttttttcatgagtaatgccgcccaactttggctattagactttgtgtgactgtgcagccatcagcactggatattagatatagttttatctctgcaactcagtcaccttgccaagaattttagtatgaactcttgacttcccagatcaaatgtgagcctgatactctaaatgacttggcaatctactgacaaatcccatggtgtggtattctgttcaccatgtgcaatggtctcagagctcagcattatctgtctgacagctcatataatatttacaggttgttattcgttaggaattttagttagccataaagattttcacagctatggcagacattagaggtctcattcatcactcttgtgaccttcctctctggaatgtagcccatctgtctctgctgttgaaatctttatggaaagtctgcccatctttgaaagtttagtaagtgatcttaaagttttcattgaatctttacttttgatatacgatatagacatataaagcactatccttattttaatttaacgttttgaaaagtgttaaatttaacttggcctttcatttaaatgacagaaaacttactcttgctacaggaactatatgcgtcacatcaaaagaaaatagaaatcatacagaaaaaaattggaatgggaaaaattacacatatatacatatatattcaacactaataactacatgaaagcttaaatactgtattataatcctgattatgactttaggaaatgaaaacgatagaaatacattttgcatataatttaacgttataaagaaaccctaagcaaattcagtaatgaagtgaactgaataggctgggttacagagcacaagagagggatgaccaacaatcagatgttgcccctttccatttctgttttcctctttttatacacaacttctcaaatgcttgcttcccctccgtctactccctccttcagcctctgatcactagtgtgaaattgcccttttgaggtcaccagtgatcgtgggatcaaatacatcttcttcttctacacccttagtctgtcaggctcaagaattgcttatacttcaccagctaggctgttcttgtgtttcatcccactttattctagcttctgtattatttttctttgacagcagttctactgccaccgccatttgggggcatttgccagggtacattcccttttgttttcctccactgtactcatctttttttttttttgtacttttatagctttcttggggtataattatatgcaaaaatatgcatatttaatatatgtaatttggtaagtttggacatatgtatacacccaagatactattgccacagtcaaactaaagataacgaacatattcattacctacaaaagttttgtgtccctttgcttttgtgtgtgtctgtgcatggcaagaacacaacatgagatggaccctcttttttttttttttttttttttttttttttgagatggaatcttgctctgtcgccaggctggagtgcagtggcacgatctcagctgactgcaacctccacctcccaggttcaagcgattctcctgcctcagcctcccgagtagctgggactataggtgcgcgccacctcgcccagctaatttttgtatttttagtagagatggggtttcaccacatcggccaggatggtctcgatctcttgacctcgtgatctgctcaccttggcctcccaaagtgctgggattacaggggtgagccaccgcgcccggccgaggtggaccctcttaatccccttaagttttaagtgcactacacagtattgttaactataggcactatgttgtacagcagatctctagaacttactcatcttgcataagtgaaactttatactcattgaataacaatttctcgtttcccctgccctgtcttctggcaaccacttttctatttactgcttctatgaggttgactatttcagacacttcataaaagtggagtcatacagcatttatccttctatgactggcttatttcactgagcatgtctgcaaggcccatccacattgtcaccaatggtaggaaccttcttttttttaatgctgaatggtattccattgtatgaaaatgtggtgtatacatgcagttctctttgtacgatcttccttccttaaagagtccagccattctcatagcatctgctatgattctagtacttatggtcttgtcctttcacttgcatttcagtgaaaagaaccaaacttatgctgatgcaaatacctgtacacaaatgttgataccagctttattcatgattgccaaatgctaatcagtctatgggcctctgattttcactgcataaaatatagactaatctgtttatcattcatgctgatgaatggtggataaatggtctagctaagaatgaaagatctgttgtatagatgtcattggtctaggaagacagagatgtagaaagaagtaccataagcccaggcagttagatactattcaaaggcatttctctctgccatactttatactacatgtggcacattaacagtagttaggagtggattcaaggctgcagataaatgctgcccaggtgagagagaaagaattggttccacaattaaccatcattcagacaacacatcatagctatgtgattacaaacattatttgtgtggtgattaacattttacaaagcaatttcatattgatttcctcattttatcctgacaacattttggtgagggagatatcattattcccattggaatataaggaaaataaggcttaggcaggaaaaagactagcttaagatcatgaagtgataggggagtcaggactcaaatccagttcttctgaatctgtactctggacattttctgctatatccagctccctctcaagatgctggattgggctttgaaatagaaagccaacatcctgagtgcctttctaaactctgagttttacagtctatcaggggaagaggagagtgtgagaggaatgttcccaaataatctactgtatcaagcagtatatctaacttgctttgagaattatgccaactaaatactattgacctgcagaaaattgatttttctctttacacttatatcaataaagagaggcttctgctgccataagtgtaatttatgtaaaatgtttttaaaacattcatagcctttaatcaagtaaatatacttctaggaattttgctttaaaaaagtaactaaaatatgtgcaaagatttatctacaaagatgttcactgtggccttacttagaacagtgaaaaactggagacaacttatatgttcccaaagagggaatttattcaataaatcatggtacatccataagtgggaattttttagcaatgaaaaatctgttgtaaccctacaagcccactcttaagcattcatcttagagaaatgaaaacttatgcttatgcaaacacctgtacacaaatgttgataccagctttattcatgattgccaaatgctaaaagcaacctaatgtctttgaacaggtgaatggataactaagctgtagtacacccatataatggcatactacttagcaatgaaaagaaacaaatcgttgatacagcaatatggattatgcattatgctgagtgaaataaaccagtatcaaaaggttacatactgtatttatatgacattctggaaaagacaaaacaagtctagtagatcctccctaatgccttttgttcaaccccagaggtgagttttctattttacctccagtgattgctgtatcggttatttatctaaactgtccccacttttttgacccacctatgttatcaaactccaaatccaccaagtatgagaaaagtagagagatgaatgaaggtatttgtgttggaattccagaaagtgctcttttggcatgtcttaaaataacattagcattctttttaattttctggttaggcccctatgttgattaaaatatgacttaacaccagggtgcatcacttggaacattctgttcatcatgcatttaaaaacggctgaaataacaacttcccctaaataatgtggcctgtgcttgtgattttcaaaactaccttgggcacaatattgaatcctgtcacctcaaggaaggaaaagcatttgaagatagaattgctaccctttcttgctcttaataacatactgtgtctgtaacacaaaaggaaattcagaggttggttttgcaataaataaatgcatgtgtagtttgctatctaaattcagtggacaataccccatgatgctggtgccgtatgataatggttgatttgtacattcaagaatctgaatcacaaagctgccctggaattacacgtagtggttataagcacatctgtataagaaaataccaaaggacaacccggtgtcatatagaaactatttgccgataaatttgcttttgatgggctactaaaaatggacacatcaggcataaaagatgtgtgtgtctattacgtaggctagctttatgaagaatgacaagcttccactggtacactgagataagaaacagctgttgttggcatcagtactgctacaagaaatgaaaaaattctgtggcacacttgtgagcactgccacatatttgatcaacttttgaatagatggaagaccagaatcatctggcagccccaaatgaaattgtcgacaacccttaagaatctcttgagaaggagcactgaacccaattccgtagaactatcatccaattgtgtgttatttctaaagcaagtagttccagtgtgtgtgtatgtgattatgatggggcagggaaggaatgaggggaggctgttgttattttcctttttttttttttttttattgtgtcaaggacatttttgagcataaaattgtaaggtttcaaacaatgactgcaaagcagttgcttaggtgaatttataaactgtgaatcaaaggggaaaaacatctttcagaaaaaaaatacactgaatctcaccattggacctatttgatggctacacataagacaaaaagcttttttaaggaaaataaatgaacacttaagaactgcaattacaaaagcttgaaatttcatattgatctagaatttataatatttttaaaattctttaaaaatattttcagctatttagttcaagcatattctgataacttctctgacatttaattgaaaattttccccttttaatgtaaacataaaaagtcaactctagataccctacgtaggtcttcccattagctcagccaggcaacgccaattttcctctgtctctcgctgcttagaggttgtttctttcaggccgaaagcccctaagccaggccaggcagccagcagccctctccagcacacttctttctgagagacgcctaagaatagtgtaggaaatccaaagtgattcttctgctatcagaggatggtctagcatcctccaaattagaaagaatttctggaccactagaatgataaaaaaaaaaaaaaactagaaaggtataataagagaaattgtgaggcctcagcccatagatacctttaaggaaagaatagccattcttttctcagtttaggtattcacaggcttggcattcacagccagtgagggctggaccaagagctctctggagttctcttcttccttttatgatgctggtattttaagaagaaggtacactgagcagccaggagctataatttctggctctccaccatgtttcctgctatagagggctagctttttaatatttccataacaacagactctgaccagataggtcaggaagtctagcccatggtttgtttgtttgtttgtttgtttttcagttggagttttgctcttgtcgcccaggctggagtgcagtggtgcgatttcagctcactgcatcctttgcctcctgggttcaagtgattttcctgcctcagtctcccgagtagctgggattacaggcacctgccaccatgcccggctttttttttttttttttttttggtatttttagtagagatagcgtttcctcatgttggccaggctggtcttgaactcctgaactcagatgatctgcctgcctcagcctcccaaagtgttgggattacaggcgtgagccaccacgcctggccttagcccatgtttttaaatcagatcttatttactctgtgaacttatttggacaggagagctgcatcctacagaagaaaaaaggacaagagaagagttgggaagagaatgagaaaggcaaagatggaaagggaagcagggaaggcaggaggaagggaaaagaaaggaatagagaaagaaggacagaaagaaatggaaagtcagagactacttcaaaacagcagctaaatgtcttttttctctgtattaaaaatttccgtctgccaaaatgaaaaagcataattaccggccaaatacaaatccatttcctatatcgtttaaatgacatatctccaaggtacaaaacagcatgtctggttaaaggttgggtgatttgatccctctattactctatataaaacaaagaagctggagtttcattacgcttaaattgtctggcagtgggtgaagttaacttttattagaagctgttctttcatattatacagtgtagtcgaggatatattagctttgacgttttcttacatctcaatacactgcggagtgaatttactgtgagactaatttaaaagggagtttttcataggaggaaataatggtcagcatcagctgtgcttcaaattattagcagaatgaaaattcaggggaaaaagtatagacacataaagttgctagatattaataagaatgcgtcttttatttctgtttctgataatattctgtgtttcttaaagctccagtgtcttaaaactatattcaggaggaagattatattgttgaggaaatgttatagtgcctcctcaacaagattattttgtcttaaagaaagaaaaaaaaccatcagatcaaacagtatataaaatatatttgtagaggttcagctttagggaagaaatcctacaacttaagcctgaaaaaaaaaaaaacaatgcaaagatcattcatttgaccaatacacagtgaagtcataataaaacaaattcctagtatgtgaaatgaaatttcacgtataggattcatcactcataacaaaagtcttattacgctctgatatcagtagacattccctcacttttggtcaccttttctaataagatcacactggtcagctgacattttgaggcaccaaattaagcatctatttggtaagtgaatttggattctctttaaaccaataaagataaaaacaaccatatcagagtgataagcatattactttagcttcaataacttagaatgtaaatatatcacagagggatatttcagctactgaaataataaaatccagtcagtcaaatagtaaaaaatattgagaaccagcaacaggaagtattataaaaaaaagcactcaagggagacacatacaagaaaccccgtcagtctactcattcagtttcttatctgttctataggtttagcagtggaaatgtttgtgggttttttttttcttcgcatttatctttgtgcctgaatgagttcagtttcgcttagattaggacagaaatttcagaacagcaggttaatccatcctgtcttcatgggcagctgagcaaacagaccaatatcagtgtaaaattgtaattctggagattaatgttgtctttcctgtttgcgatgaatttgacctccttgcctttctttttttcctcccttcttttcagcgtctgtccagggtccctgggagagagccatctcgccaaacaaagtgccctactatatcaagtaagttggaagtatcacatttttaaaagagcatttattgtgactaacctgtatattcacaagtgagtttatttttaaaatgcgacattagcctggcctacaatacctgtgtcttttttttcctgaggaagcttggataaaaaacttattctaaaattaccattgtaaatttgctgatgcaatggggaacgacttttaagaaaagtttatttaatgcaggatatatggtgtgttttgtgacagagggggcggatttttcacaatagaaccaaaagctccagataattttattgatagtgggagtcaatctttgcgagaacaatttcttttatttaggggttttctcacatttcttcttccgtcaaagatagaagatttccgcagttatatgtacacaactgttttgggtgaatgaatactacatgtttccaaaaggcagaaagcagcagtcctcgactcgtagggcttagttgttcattcttgatacataacactcagtatttgtcacctaacaacagaaagatactgttttctggaaacatttgtgccagtcaaaagaatacgagtgcttggaagcaccttctgtagtattttgcatgaaatataaatgacaatacattgggtcaacgtggaagagagaggagagaggatattgagtgattacgataccttcacagtctctcatccattgtgcactagagtctaacttaaatttaactttgaattggaaacctcaacaacaattacaatttactgggttcataaaatagtcctcgataccaaccgaagtctttgaacttgcttctgccatgagtctgactaaaaatattagatgttttcccatttttttccgcctgccatcttttatcgaatctgtttttattctttcactgtccatcaattcttcttaattcggttctaaagcaataacagcagtcctagatcttcattactacagtcctcaagaaatttgattttatgcctctattttgttaactcagaaaaatgggagtgaaggtagtcttttgactctttcaggagaaatacatactttaggaaacggtttaccatttgtcttattacatttttccagatgaggtatctcttaacttgaaaattcttttttagtatgtttgattctgctttttagttttcatattttatgaatttaattttattattgttatatttaattcattagtcactcaaaactgtacattttaaatacctatttaaatcacatgctttattaaataatatattgctgtagacatgcactgtatattaccttacatccactgtatattttatggaacaattttcttcaaactctagacagtgatttcctacatcagtgtctttgtcctcacaaatttttatttccgactaagatgtttgagacctgctacttcttcaaccaattcataaagctctcacttttatccaattcctttatgagctgaaataaagactctttttctcctttcatagatgaggttttaggatcactggagaattcaagacacctttaagctattattctccaaatgactacttgtttggggctcactagaggtctcacatggattgctagggtctccccggtcccattgtcctttccctatatattcatcttctccctgatgttacttctactacaagagatcccagtacattgctgtgagggaatggaaatgaactccgtccaaaaaataataaagagacaaattccagaaaagctgtaattcccttctgtgtattagtctcttgctgtttctcagtggaattagagagcagctacatatcctatttgtccaatgctccttcatgtacctaaagaccatggtgatggtattgataagggcacagatctatgaataagaaaacttcaattttagtcctccagtctagtcttagaggctctgtcattaggcgactgtatggctttaggcaagtcacttaacctataaaaatcttggtttctttctttttttttttttttttttttttttttgagatggagtttcactctgttgcccaggctggagtgcagtggcccgatctcggctcactgcaacccctgcctcccgggttcaagcaattctttcgtcttagctcccgagtagctgagactacaggcacctgccaccatgcttggctaatttttgtatttttagtagagacgaggtttcaccatattggtcaggctcgtctcgaactcctgacctcaggtgatccacccgcctcggcctcccaaagtgctgggattacaggcttgagccaccatgcccagccaaaccttggtttctaatttataaaataaagagttggactagatgatatctaagatcctttttagctctaagacgtaatgagcatgactcattcagttgtcctgtccaaacttaaaaaccgaagatctcagcttttgttcgataatatctttatttttaaaattcattattttaatgaacataatgtaaattcttactttaaaaaacaggaattttatttttccactgtttaattagctttagatatgccctatcaacccactccaatttcaccacacacctctttaaagagctcaaatcttggtatataatttaggattattatgcttcctggctcatgataagagagagagaacaataggcaggaaaatttgccaaaaggtgagtatggagaccttaaaagcctctgaaataatcagttccttgaaatgaggaaattacgtaatttctcaaaaatatctctgaaaccttatggagagcaattctctctacaattataatctctttgaaattagggatggtataatttctcaaatatgagtgtaaaatgttaaactgtaatatagggaaaacatacatgtttataaaatgaacattgtcagtaagcagatgattaatggcacttgtgtcttattagccattactattatctaaaatgttctatggaaaccaaattaatttgatgtacaaggttcggtggactttatgcacagcttaatgccgttcataatctgagatgccgtcttggtctaaaaagaacaaaaatacgtttacagtgacagtgcttcaaccagtcctcatttttcctcttttttatcttgtttgtcttgacttccagtcaagagtttttaccacagatgcccagctgcaaaaccaggtgtcttctctggctatgtttttaatgctttgtaactttttcttttcaatgctgggataaagggatcgcccacataacaagaggtttctataccagtggcacagttcctgttggttgttgaattgtgcactcattcttgagattttaagtcattaacatcttttgctctagtttgcaaatcaggcagtgtttatgcctgcatcctgacatcagcttttcatatgaggctaagaaccttgattttgatacttcaaactacgtgtttgtctagtttatttgtccacagcatacatcattgttacagttttcatattccctctcccttggggctcccttattcctgccagcatctctttcaggttatttgattacagctttcattgccactgaaaaaataatcaccaacaatgttcaacctgttacaactgccttttctactctctgccattttgtagttttttggcctactgtcaaactcatgaaaatttcaatataatagcctttaaccagctgctgcattctgttaggatttctttcacctttttatgttgcatgctcccatatgggtaaaccaaacagagccaagagctgggactctcttgctttcttaatgagttagaaaattgttcttctgtattctggactgtcaaaagaatttaggaatcccaaacatgcatgcaggatgttccagtatagatgtcataataaaagcataagaaatatcacactgggtcagaccaacagggcaactagcccggaactctgtcccagatgaagataccaatggttgttttgtcaggtaacctagtacattttaccttaaaaattcggatacatcatgaccacttcttaataatgcattgtaaatcaactggcagtgagtttatccaatggtgtcaaacttttcctattccccacttcagctttgtcttaataataatatgttccataaatgtaccgacttctatataaatataggcattttaatttctcttgaatctgcatcctttaacctcaaggaatggccttaattaaattctttgaaattcagtaaaaacatttatatttatccagagtcgactttagcctcacattcccctactaatgcttttcattttcatcttcccagtctgagaaattctaatcctttttagtcttttagtctgtccttgacggaaagataagctttccccttgattatcttagttgtttttccctggatcttttccagctctgttatatcttctttgggatgtcgtgactagggtggcccaaatattggttatgaaatttgttagcattgtctctagtttccactcactcatgaagaaagtaaatgttatttgctgtctcccattggtgcagaaatggagagatcaattgaggtcataacctcttctgcatatattagttctagccgaaggttggttttctgctacttttctgtaataccagcaaaagtgtttgaccttatatttctgccagctgtcccttaggaaggatttgatttttagacaagctggtcctttcctccttcaaagacgctgtggttgctaaatattgggaagaattcactaatgaaactcaggagtaaacctgctgactccatcagcagtaatgcatttcatcaggttccctttcgaaatatctctgaagcccttcacagaagagtgaaagatggggttcttgggaacttgctaactgctcagctttttttacatgcaatgctcaagaagcaactcatgtccaaaggagtgtttatcttttcctgctggtaattttgaatgttgtatatacattgctgtatatgttgcctgatgaccttgatcgacccttctcttcactctcaatctcaggcatgtttccacaaccatttattgcatctgagttttgctcacaactttctgctgcttcctgcttagcaaaatgcgatataaaaccttattggatgaagttaacagttgcttcagtcaacatttcttgttactgttgctgtttgtgctgacaaaattgctgatttgggttctgactgtcctgtcttcttatggcctaccattcctatagctctatttgtacgagtatttgactctctgcctggaactgtggccatctgtctagatttaccttttggtatatgtggctctctgtatcctgttggtctacattctggtttgaactcacggatcttggtctggtttttagtaccagtgttcccctaactccagtagcatctgaatcttgacaccaccttcccctgccccctactgtattgcctctattactactttcatggcaattttttcggattccaaatatgtcccatgcttaaagcatatcttgctctcattcttgttctagcccctgttggtaccaggcattgctccaattcaagttttggttggttgatttcttccttcataatattgattgctatttcagtacctgtatttatatacagagggagcagtgcctaactacatcttagccttaacagcaatcaacgtgttaaatatccctgtgttggctggtttgcagtagacacgtcttctgacaatgagatgggctcttattataaagaaactggagtatgatatcaacatagaaaacatttcctcaggccgggtgcggtggctcacgcctgtaatcccagcactttgggaggctgaggcaggcagatcacgaggtcaggagatggagaccatcctggctaacatggtgaaaccccgtctctactaaaaatacaaaaaattagctgggcgtggtggcgggcgcctgtagtcccagctacttgggaggctgaggcaggagaatggcgtaaacccgggaagcggagcatgcagtggacgagatcgcgccactgcactccagcctgggtgacagagcaagactctgcctcaaaaaaaaaaaaaaaaaaaaatttcctcatttcttattccagacacctcactcttctaagaatgatacaagtcttctgacattgggtttgaaaatcagttgaattttgtcataatctttcatacaatgtgaacacatcatgtagtatataattttgtgctatttctggtaagatccttcttatgtatatttttcttcaaaatataccttttagcagctaagacaacattaaataggggaaattttaaataggctaggcatcgcaagacttgaattctagttccagctttactgtcacctagctattaatacttgaccaatgggaaattgcttattttctgtgggcctcagtttctccctctgtcatttaaggaagcagaatgacatgatatcataggtcatttccagtactaacattttctgattttgtgaatgttgacttcgaaatagaaattgtttgtgatcattttccagagaagtgaaaatgaatcttcatattgcccttgaggattcttattgcaccatcaatcttatcgggatagaaaggacaaataatattaaatgtttcacttaactatttagcactattgatgataagaagtggatgcaacagagaatcagctgtctaatttgatctgtcagtctttgaggatgctggtgaatgattcggggtaattaaatttttgaaatcactgccaaaagcctgatgctctgacttttcaaaaggctttagtacacaaagataacccagaggtcaatcttctctgctgtgttttctcctctgccatttgatggtttcaaaggtcacgttacctgagtctcagtaagctctggaaccacaatgaaggaatagttggtaatacattattgatgatataatcatgaaaacaattcaggttaagatattaactgaaagagagtgaaaggggtgccatagtgttgtgcagagtgctgagtctggttttggttttatagatcttgttgggagatgtagatgttgatatcatctgtgtctcataggttcatgaaaaaaaccctcacatccttttttgtagtttcataagctgatttgtatcaccttgactgaaataacagactccaggaggatagctgttgttatctctttttctagcatagtgcctcacagataacaggtacttggtaaatattggaatgaattcatgaacatatgtcagtaattctatgtgcttttcagtttgctgactcatttcaccttcaaaacaatcttgtagtatttgtgtgtcaatttagatttaccactcaaatccatctctcatgccctctagacatgaactttagtgttaggaagcatgccgagtgtttgatagagtttctcatagctcctacagtttggtgcttaagggacagtccttggcatggatgtatgaatggtacataccaaaacatgagttctagattccgttctatcttaatctaacaatatgataaggagtataacttagctcaacctcaatgagaaggttgaactagataatgcctgggaccactctcagctctagctttgtttcagtagaactagagtctgtttttcctaaatatcattcatgaggcttcttctggttttctagtggtcaatagagctttaaattgatcaactactgtttttcactgagcattgtggacaggacctactttttgggccaggatatagtagccactgagtcttaacagaatgtcatcaatgatacatttttattttacagaaaaatgttgtaacattctatatggcatatgtcatgtggaaaggtggcaacatatatacatacacctatacatgtggcagctaaaatttaatgtgtgtatggggaaaataatcctgtattataatacacatggtatagcattccctgcctcattcgtggcacttttggaaatgtgagaatgagcatagaacatattcaagttggtttatccaaaagaagaggagtaaattatttcagctatttccccattttctttttctaactttcttaaacatgcactttcttacataatcacgtgttagaaaaaaaccagtagtcacatcaaataaatctgcatttgaaacaactgtatcatatcccaactctgttcgtttgagccatttgcttaacgtgacacccattctactttatgacacataaggaatattgcttaagaaatgttaattggctttccttttctcctctgaaactggattgaagtcttattgacctctattagatactgagtgttcaggtttttaggaaaacactcatagagatatagccccagtgtgagctgcatttttagaatattttctagaacccaaatatgtccctaatcaaagttagtttattttcattcttagcgttcccacgtaatttggggtatgtgtgaattcccaaacattcccgggcctctcctaggcttctctaattgcttcttattctgttcccctgggaagcagcatcctgttcccttcacaaaggtcagcagcaacagcccaggcaatgttttaaaataacttaataaccctgaactgcctctctcttctttgggataatttccttagagcattagtcctttgaacactgacctggttgcagaaaatgcccctttctcagtgggaaaactccaaatcccattcagtcttcccctccttccttccaggggatagggtgggggagtagggggtagggagagggtattaaatactttcttcaggaaaaatgttaacacggtaaaacactctctctctctctctctctctctctctctctctctctgtgtatgtattcttttttaaagaaatagactgtgagtgcattgtataaatcagtgctgtcacgttgcaaattttttaaaccgttgtacaagatagaaaaacagtatctctggatattgactctggaaagcttctaagagcaggtcctagatgagacttagctcactgtcggcattcggcaaatgatcacgttttctgtgataccattaactcctggggggatgaaactgaaaagcctcgctgctcttcctgaaactctcaactgcttttttctgtttttctttctcagcttatccacatccatcttggtccccaaagccattgcatgtcagatggtcagtgcaatgtgtaatttttaacttgcttctttgttgctttagaaggaatcgttttgttgttttctttccttttggtcactatttcttgttcatgagttttctgtaaacagtgtgtctcatagataagtccatgtaatctgctagacaggaagaaaagcaaagtttaatgtgtgcctactatgtgctaaatgacaaagtgtttcatctgtatcttcccatttaatccttgtaacactccacttattatccaataaagaaaaaaacggctatcagtcgggcgtggtggctcatgcctgtaatcccagcactttggcaggccaaggtgggtggatcacttgagctcagcagttcaagaccagcctgggcaacatggcgaaaccccatctctaccaaagatacaaaacagtagctgaatgtagtggcatgcacctgtggtcccagctactcaggaggctggggcaggggaatcccttgaaccagggaggcggaggttgcagtgagccgagatcacaccactgcactccagcctgggtgacagagtgagaccccatctcaaaataaataaataaataaaagttaaaaaaaaaaaaaaggaagaaacagctgagattcaaaaaagttggaggcttatccaagtcattctaataaaggggaggggggagaattgatacttaaaatcatcatgataagaaggatagacattggagattcagaagggcagaatgctgggtgaggggtggataatgagacattacttaatgggtacaaggtgcactactttggtgatggatacactaaaagcccaggttcaccactatgcaatacatccctgtaacaaaactgcacttgtacctcagaaatttatacgaataaaaataaataaatcaaataaaataatcatcatcatctcagctattgcttctagctgtttcaactttctaatgtttttgattgaaaactggccatttgtataaccaaatgtggccaatccaccactgtgaggctgccatcttgggcatcaccaaaactactctagtagtccttccctgcactgttaggtggattttccttggcgtatcttcgcaatcaagttgcagagacctaagttactctttgctgctttgggcaataaaggggaacaaaaaacaaaatgaaacaaaaacttggccagccctgatgtaagcactcttctacctccctgcaggctgagaaaacaaagtatttcttttttttttttttaatttttaaaatgtttgattctggtctaaatcaattaaaatgagatctccccccttcttttttctttttttcttctaaaaaaaaaaaacacaccaaaaaaccgagatacatgtgcagaacgtgcaggtttgttacataggtatatgtatgccatggtggtctgctgcacctaatgacccatcgtctaagttccctcccttcaacccccaaaccccaacaggccctggtgtgcattgtttccctctctgtgtccatgtgttcttaatgttcaactctcacttgtgagtgagaacatgcagcgtttggttttctgttcctgtgttagtttgctgaggatgatggcttccagtttcatgtccctgcaaaggacgtgatctcattcctttttatggctgcgtagtattccatggtttatatgtaccacattttctttatccagtctatcattgatgggcatttgggttggttccatgtctttgctattgtaaatagtgctgcaataaacatacatatgcatgtgtctttatagtagaatgatttatattcctttgggtgtatacccagtaatgggatggctgggccaaatggtatttctggttctagatccttgaggaattgccatactgttttccacaatggttgaactaatttacattcccatcaacagttcaaaagcgttcccatttctccacagcctagccagcatctgttgtttcctgactttttaataatcaccattctgactggtgtgagatggtatctcattgtggttttcatttgcatttctctgatgatcagtgatgttgagctttttttcatatgtttgttggccatgtaaatgtcttcttttgagaagtgtctgttcatatcctttgcccactttttgatagggttgtttgtctttttcttgtgaatatgtttaagttccttgtaaattctggatattagacctttgtcagatgggtagattgaaaaaatgttttcccattctgtaggttgcctattcactttgatgatagtttcttttgctgtgcagaagctctttagtttaattagattccatttctcaattttgtcttttgttgcagttgcttttggcgtttttgtcatgaagtctttgcccatgcctatgtcttaaatggtattgcctaggtttccttctagggtttttaggatttggggttttacatttaagtctttaatccatcttgagttaatttttgtgtaagctgtaagggaggggtccagtttctgttttctgcatatggctagagagttttcccagcaccgtttactgaataggagatcctttccccattgcttgtttttgtcaggtttatcaaagatcagatgtttgtagatgtgtggtattatttctgaggtctttcatggataggaagaatcaatatcgtgaaaatggttatactgcccaaagtaatttatagattcaatgctattcccatcaaactaccatgaccttcttcacagaattaaaaaaaaaactgttttaaatttcatgtggaatcaaagaagaccccgtatagccaagacaattctaagcaaaaagaacaaagctagaggcatcacaccacctgaattcaaactatactacaaggctacagtaaccaaaacagcatggtactggtaccaaaacagacatatagaccaatggagcagaaaagcaaaggatttctaagtcatattccaccacctccatcagggcttccctaagatagagagtatggccaagaccatacttaataaatgtcatggaatgtgtttctcttcataccctcaattgtaagtctttctgaaaggtagcgcgtggtcaatttagatggacaagaagtgctctgcaggagcctttgcaacatttgtgcatgtccttgattttgacaccaccccccgccccccattccagaacagatcgtctcatccttcccttaagccagaggcctatggttctagctttactaggcaaatatatatggtctgtggctataagtcacaatttctcccaagccttgagctgggggaatactgagtctgcccatgtattacatgcagaacatttcatcttattgcagaatgatactttattcttattgcagaatgatattcattattgcagagtgatattctttagtctttattttttatcattataactacatggtgcaaaagaagtatttctcatactttttctcataatgactcaaaattacaaaagcaatctgggcaattaatatgtttttgaagataaataatggcttatgttttctgaagattaagaaaaatctctgtctgaatatagctgggcacagtgtctcaagcgtgtaatcccagcactttggggggtcaaagcagaaggaacacttaagcccaggagttcgaagccagcctgagcaacaaaatgatacctggtctctacaaaaaaaaaaaaaaaaaaatccttggcatggtggcatgtgcttgtggtcccaggcacacaggatgctgaggcaggaggattgcttgagcccagggggccgaaagttgaggctatagtgaaccgtgtttgtgccactgcactccagcttgggcaacacagcaagactctgtctctaggaataaaaaaaaaagaagaaagaaaagaaaaatctctatccgaaaaatgtaggcaccctgtgttaatatgtaaatacaagtgctttatcaaataaaggctagattaattgttttttctcgctcttacttatatcaatactacaagaacttttctgccaaaaaaaaaaatcaaataatagaaaagaatgaatcctagatagagcaggaggggctgagcaggcacagcaaaagttcaaggtggaaatatctttatgcatccaattaaaagtaatttgtgtacattttactcatatatctatatgtacacatacatacatacacagacacacacacatatatatatatatatatatggagagagagagagagagagagagagagaggacaacgaagaggaaactaaagagaataaagggtattaacagcaggtctgtgacttattccctgggggatgtgaagggaataaatgaccttaatagaccacttcataaacatgttaatgacctcccagaccttcttgtttatcttgttaatagtggttaactagaggaaagatacctgcaaatccctatctataaaatgattttagtagggtatacctggcctggctagatagcttattgtaaataaacctggaatgtttggatttatgagtcgtggctggctggagaatagggcatagctacatgaacgtttttctatttttgtaattgacagattataaaatggaaaacttttgagactgaaatgatttcctttcaatgtttctgtgtaaatttttaaaaacgtatctgttaatatgaaaccaaagcacatcataatgggaaataacatggatgttttggaaacgcatgtgtgattatttcaggttccccagggaaataatgttctatctgtgcccagcacttccctataattctttcagtcattaataaagattggtactagataagaatctgagatttgtgtgagtctgatgtgagatccaaatgttatacttacacaatttgtgtttattttagtttaaaaattatctttgccatgagcaagaggggaaaaaaaggaggatgagcgggcctacatatttttccttaacatcttgtcccaagttttaggaaatcacaagtctaagaaaaggccagggtcaggactaggaagtgatataacagttatacatgtctacctttaaaattatataagtaataattaatttttaaccttattttaagcagatcctagaaatagcaagagcctctataacgtcccagctaagaccccaagttttctttcttgtttaactcttgaaatattttgttaattttcagatcccttgtctcctcagttcagctgtaaactctctgacaacgcttgtgccttatgcatctttgcatcatccctagcatgtattatatatctcacatgtaaaaataataataaatacttgatcatttgttttgattttgatgattaagcactggaagctgagctatgatcccaataggtatgcttatttaaagaaaaatagatggcagtccaggcgtggtggctcacacctgtaatcctagcactttgggaggctgaggtgggcaaatcacctgaggtcaggagttcaagaccagcctgtccaagatggtgaaccccgtctctactaaaaatacaaaaattagtctggtgtggtggcagatgcctgtaatccccactactcaggaggctgaggcaggagaatcacttgaaccctggaggcagaggttgcagtgagccgagatcgcaccattgcacttcagccagggcgacagagttgagactccatctccaaagaaaaaaaaaatcacacacaaaaaaatagatggcacggcacagcagcttatgcctgcagtcccaacactttgggaagccgaagcaggaagatcacttgagtccaggagtttgagaccaggctgagcaatatagcaagactccatctagaaataaataaataaataaataatttttaaaaaatagacaataacagataaagaagttccatgttatttttttaaattctagatagccccactggtgttacagtttattaaattacatttggaagcgattttttagcagtccatttattttgtatatttcagtttgttgagagcagatggggttgagtgttgatggggttgattgcctggctagattatgctataaactataaatctttgaaagttactgttttgaagaaagcatctttaagtgaatatattccttcagtagctcctattaccaaaactgttgtgagaatatcttaggaaaacaccttaaaatcctcttctatcaaaactcccaagctttcttcaggagccagcattgttcagtgaatgcatgtaagcctatgtcttaatagagggatccctaacctctggaccatggactggaacagcaggaggtgagtggtgagcaagtgaacattactgcctgagctctgcctcctgtcagatcagtcgtggcattagattatcgtaggtgcacaagccctattgtgaactatgtatgcgagggatctaggttgtgacctctttatgagaaactaatgcctgatgatctgaggtggaacggtttcatctcgaaaccatacccccgcccctgcctcccagtctgtggaaaaattgtcttccagaaaactcatgcctggtgccaaaaaggctggggaccactgtcttaatagatcttgaaaaaagttggagtaaggtaagtggtaaatcctaagacatacattgaggcagagctgcagtggtatccagtagggaagaaaagacttcaagtttagaattcagttatactcaaccagtttttgcctttctctgttaaatattagatatcattaccagacacatacaaaagattttaattgcatgaatgcccgatgttgatacaagagagccgatttttttttcacacatagttttttggggtttttttggtagggagaaacatcatctcatgatatcgttttaaaggtgctttattatcaaggaccttagagctttttctctcactcatatttcatatactcttagtcctcaagccatttctttttactgaaagcactatagagtagcaaaaggcatcattatattgctcagcctcattcatcatcaacaaaattgccaattatattccaagtccttgaatgtattgtttaaaaagatgtataaggtgaaaggaagcagttcaatgttgaggtggaagatgaaacatactgactggtagattcagagcatactaatcttgttttcacttgtgaactggaaaaaattaacatggagggatggagaaaacatgttcaaactacaaagtcattttttctgagaagttatctgactgtaactgtaactgtaactataactcagggtatatcagagggctcaaatgtggaacacttctttaaaattaaaacctaaaagtcctgatgtgtaatagaacgtgtaaaaatagcagcctctgaaggatctgagatgagcagaggaacactgaataatataatctgacagtatgggccatacccttacagtagttgccgtggcctggaaactatagaattaattcagtaaaacatcagaaaaaaagcaacataaatataaaatattttaaattaaaaagactgaataagaacagaaaaaaatcccctagcaaatcaatattgcttggggaagcatgaatcccagaccagcaatattttaatccaaataacttttagttccatcgtgaacacctttatcaccaagttttataaagagtggagtgaagaaaaaaagtacttgaggttgttggaaacacttctcaaagttggtggctttattcagagattcatgcttgactgtaccaacttctgtttaatttatacgtagtactttgtcaatttaggaatttggtttacttgtcctttcctaaatatgtgtattacaaaacaaaaaatagagaaatgataaaataattacaaagatgattaagcaatagtgttggctatagtgaacagattattgccattttatagagtaataatatacctaaggaaatctgtgggaaatttaatttgggatataaaacacagaagtcaggcggagatgaaataataaaccaataggaaattaaatttaggcatgagagtccaaagatgtaaattctatagatgttataaaataatatgtatgcccttacataatttcattactctctgaacttcatttctcagtgaaatatggggaaatgatactgaacagtgcagcagctcttccgcttatgaaccaaccagaagatatataaacaactcttaagggttatacattataaagatataatttagtctggatttttttttaaatttgaaaactaattttatataaaccctaattgggcaattctccattctttgacttgaatattatagtaaatatgttttcccaatttccaagtttcatgtattattttcaaagaaaaaagacaaacttttaaatgtccagctacctgggacttcctctgattatcttttaaggtagttcaaatatatacaatttcaaacaacaacaacaacagcaaaaaatattttgccagacaatatgtcttgtttgtttttaatgttcacaatgtaaagtacacttattgccaaacctcactttcaatggtgttacaaattagccaagtataactagtttgtaaatactaataagaaggttgctgaaattcagccctgaatatttcttttctgcaactccaaagaggaaaatttttgaaatgcaaaccttgacctttatcaaagcctaggtgaagtttgttggaggtgtttggttttttgctggtgctttgttataatgcagtttgaaagtagactagattggcaagacataattggctgctgtgtggagaatgcatttggtggaacacgtgagttaggggtgaggaaatatgaagagccagagtggaagcagggagaccagatagtagtgtgggaagcactggtgttagataagatctagataaaggtagcagtggagatcacaagaggtggttggaatcagggaatatggtttagaaacaatcacaggtcttgctgatgcattggaggtcaggagggacagaaagagggcaatccaggtgtctcctcggctttcagcaggaacaggtacttaaagaggaacaaatttggtagggaaaatcaagttttagtgttccattgcagtacatggtaaccatggctaataataatgtctcatatatttcaaaattgctaaaagaatagatttttaatgttctcaccgcaaaaaataaatgatatgttggtgaggtaatggatacgttaattagcttgatcaactctttctacaatatataccaagatcaaaacatcacatcgtatcccataaatatacaaactattatttgtcaattacaaataaatgaaataaataattttttaaagagatgtcttaaagggtggcttgaagagcttctgtgctccaataatacctgcccattagccatactttgcttccagcaacaacaggaaaacatttaatctaaacaaaaaaaaattgcttgtcaactagatagctactcttccgtgtagaaaccctagagctgcctgggtttagacatgtttaagtttgaggtacttattgggtatctagctgtgcagttcaaaatttggatctgaagctaggggaagacgtcaggacaagagctttaacttttgtaatcatcaatatatacatccttcttagagtcatggggtgggatgccatcatattgggatgagggaggaaaccctgggacttcacaatatcgagctagtttctgttttgcaaaaggcaaatgtattaatgaattcattacattaattaagcaaactatatttattgggggctattgtaccagctattgtaaattttatattttatattatatatatatatatataaaatgctcacaaaataaaggaactaagtcataaatatgcatatgatttacataaaggagctaaaataaggatctctgtttctgtttcaattctttattaaagatctatctaagactataaagacatatataacaaggtacaggaggtaaagagtatattcttaggcatctaaaaatttttcctatgcttttgaaatctgtgtgatttactttcttgaattggcctgtaatataggagtacaatatcattgcagagattaattagtgtgtttgtgaactgttctcaaatgctaaaatgaaagcataaaactataaaatggcatcattattccttaaagaagcatagtttccaagggtgtctctgatcattgtcacagcataaatgaccaatttcacccataattagccaagttagtaagaagttattttttactgggtatattttgtttaacctcagttatatttgtaaaagtagaaactgctacttgttactgctttcagaatttctcacaaatgctaaaatgctttttaattctaatgcacttaaatggtttgattctccttacctaagaaaaacatttatctaaagatatactcttgactgattcattcattgattcatttgtcaatagatgtttatttatcagaatatgtgcaccagatacattgctagatgtaaagggtacatttggtgagcaacatgcatgatacctccaaagtatagccagggaatagataatggaaatgacactaagaatgaatacatattaacacaaaaagagagagagagtcatgtgtcaaggcaatttagcaggagggaacttgtcaatacaagggattaaaaggacagcatgactagggctggaggaggtgaggagaaaactcaaaaagtcctctggctgatgcaaatgaattggatgaggagcctatgaatacaaacgtttgaaggttactgatgaaagccaggtgagagaagatgggatttggaccaagatgatgatagtttggatatggtgagaaaggcatagatttgagagatttttaggaggtaaaaatccttaagatttgaggatagatatcataggaggaagggcgcaaagagaaagcaaaacatgtcaaggaatcacacctagatttctgggcaatgcacagttggtaattctttacagtgagttagggaactctaaagaaagatcagatttagggtggcaatttgattgtaaatgtttggatttcaaatgattggtgacatccaaaaagcactgtaaatagacagatagtgtgcacctaaagaaagaaggaggcgcatctgggttggagtcactaatttacatattacttgtatatagctagtaactgaaaccatgagtgtgaatgagattctgatgctaaattctggaaggtcactttttaaagtgttttgctttttgaagtacaggtgcaatactaaaaataaaaaagactaatttttaaaaattaaattaaaatgaaaagcctggaaagataaacaccaaagttatgatactagttgtagtatgggagagggggcatcagagaggatcggaatttcatcttgaatggtgtattttatttcaaaagaagctttgagcaaagataaaatgttaattctgagcattagaaggaacacatttgtttttttgtactgtggatctttttgtatttcctagaactcttaatctaaatcaaatattgcaaaatatatcactgtaaacaactggttggtcactagctttttaaatactttgtagcaacttggttgcttgtcagaggtcttctttgagtgaagtctttaatttatagttctttatgcttgatcagcataattgcaccaaactgttacttaatctgaaaaatagctgtttcctagagccctacttaatactgaaaacctactgtgtttgtattgcaattgcatttttttttttacttttccccctgcttttcagtttgtataatttctgttaccctatattcaagttcactggttctttccttgtctttgttgaatctacagatgagcccatctaaggtatttttcttttctgttactgcttttaatttctagcatttccatttgattcacttatagtttccagctctatactgaaatatactgaaatatagagctggaaactataagagtgaatcaaatctaatcttgcatattgtcttctaatcttacatattttctatctaatcttgcatattgtctttcttttccctcaagagtctttaaaatattaattatggttattttaaatttcctgtctgatagttccaacaactgttacatatctaagtctggttctgattcttgctttgtctccttagactgtgatttttcttgcttaggcatgctttgtatctcaggggtaaaagtcaggcatcttagatagcgtaatagatactgaggtaaataaacctttgacatggtaatttatcttaatctgactgggaattgggctgtgtttgatgttggtagttgctttggttgtcattgttgagttttgttgctgctgtggccaccagagacttcaaattcctctggtaactttgtttcctcattggaagcttgttagtgtagtggttgagtgtcgggcagaggcattctctaatgtttgaattaatacacagttggcctgggtcttggggatgtggtctttacaattatttctttcccttcctccagaggtagagtaacttcaacctcccattcccttcctggagctgcagtggatatccaccagtgttctcagtctatggccccaaggccctttctcctgcataaggctgaaaaacaacaacaacaacaaacaaacaaaaaaaaacaaacaaaaaaagaacaaaacaaaaccacacatagatgagatctggtgttcccttcccctaaaatgcagtggtatttcctcagtgcctgatatggtttggttctgtgtctccacccaaatgtcatgtcaaattgtaatccccacatgttggaggaggggcctgatgggaggtgaatgaatcatgggggcagatttctccgttgctgtacttgtgatagtgagtgagttctcaagagatctagttatttgagagtatgtaggactttccccttcactgtgtctatcctgctgctgtgtgaagatgtgcttgcttcccctttgccttctgccatgattttaagcttcctgagggctccccagccatgcctcctatacagcctgcagaactgtgagtcaattaaacctctttgctttataaactacccagtcacgggtagttctttatagcaatgtgatgtcttttcctctgaagagaagggtataagcagattcatggtgactagctactgtgacccttccccaatcagcaacacagagggtgttggggaggctttctccagattcttcgcatcctccttgtgaaggcaaggtacagttcctgaaggaagaagcttgcaaaaggttgggactccacctatggcagtagcccccaggatcttcacactctcaggctagctcccacatgtcccccaacaatttaatctccctactagtttatatggcatctgctccagggatccaaatgctcaggcactgcttctggctaaaggccaatctctctccagatttcaggttgttctataatgtcatttctctgatggactgatgaaaagtcattaatttatctgtccagcagttttcttgctacaagtatgggagcaacctctttgcagctctccatctccatctccaagttgaaactggaagtctgagcaatacattttagaaattaatatttgtaagttttccgtgtcataacaaaaataataaatgttcactgtggaaaacatagaaaaagattaaaaatatttaagtgcccatcaccacctagacaactgcaatgaacatgttggtaatgtcttcttccagttttttaaaatctgctgataaaatacaaaagatattgtttatataactttgtatcctaccttttcttgagcaatgcaagtttaaacctaaatacgaagatactctaacttcctactttacatttttgacggcagatgtcagctgtcttcccaagtgcagtacccttggcttaatatcaggtagacaaataaggccaccacaaattcacctttcacctcaataacacaggtaatttgatagttctacagaccctataatattacttgactgaagacccagaatacaagtctttcaaggattactctagaaactatataaagtattggtatcatctcccttcatcatatcttgccaaatccaacaggtttggaacttctgtaggaagatttttgtaacatgaaaaatgcgtgttgcaccttccatatccagcaaatacaccatcggttttttgttggctgcaccaatgacataaaatgatttcactgaatagggggtgacccagaatggaaatgtagagcatcgaaaataaaatcaaccgacgcagtctttgcagcaaaccatgtggaaacaaatttaaatatggaacatactctttccaactcatcttcagatgttgctttaaaatttgtgcaggtgaaaaaaaaatctttattttaaggtaactcaatcttttaccattggagagaatagaattatttttgtttcctcttgtatattcccagttgtttaaatgttctctgtttccttgtgtggacacataaatccaaatatatctaatatcaaggtatttaccatatgcagcactttttcctcagatagttattttttgaaatattcaaatagcttacctgtatcatcccccccatccttttttttttttttttttttttttaagacggagtcttcctctgtcaccaggctggagtgcagtggtgcgatctcggctcactgcaacctccacctcccaggttcaagcgattctcctgcctcagcctcccaagtagctgggactacagttgcatgccaccatacccagctaatttttgtatttttagtagagacagggtttcaccaatttggccaggatggtcttgatctcttgacctcatgatccacccacctcagcgtcccaaagtgctgggattacaggcgtgagccatcacacccagcctaccctattttctaaacgaacaattagttgacttttcttcagttcttactcagaaatatctgaccctaggttccaacttttgttttgctctttgcagttagtttttatgtgtactgttagggagatgtgctttttttttaccttcaaatttaaaagagagagttttcaattccttttaagtcaaaatacaactgttctactctaaagctttctttaaaaaaagaaaagtaccaaatcctcatccgtagtaattaattttgacagtgtaggctcagtagtgattcacaaacctgtattttgtgcatcagcattccttattattctaattaaagtggaacattgtgccctcgctaatcattaatgggttttcattttgtaaatgacatttgcagaagttaaaacagcgagttcatgtgaagtccacaggcaacggtgttgaaattagcatcaccatagcaacagtcttccatcattagcattcagggcaacaggaggtgttttgttgtgttttgtttcccaaaaaaagaaaaagaaaaaaacttcaaaggtaaagcctacagaaactctctcagaagatatttatgttccttgtgtgtatgtgtactgtactagacctctaagtctacatagaattttttttaaaaattgcaatgtggatcatctcctttccagatttgtgttttgcctagtatactagctaaatttcatgatctttctccagctgtacacgtctgacctgctgagcagcatttactcattgccaacctgctgctcaccaatagggtttcctacgtggatgaagagagtctgtattcatgaaaatatttggttcaatctaaaagtattatgtgtattcatgagtttttaatttaattcatggaaaatagatttatgctgttagatcctctggtgaactcatttagtcatgttgtagatataggtcaatgattattctcattcatgtttagacggaattaaagaggagtcaaatagagaacaatattatcttaactgagtctctggcagtggtattaccactattactctgtatgtgtgtgtgtgtatgtgtgtgtgtgtgtgtgtgtatgtgtgtgtgtgtgtgtgtttgaattctaatattctgggaaactttaaaagtggcatatctagcacttatgtttttctcagtactaaaatgcataaaagagcaccatattgacctaccagctgcttctaaatcacaccagtagtaggtaattatgaaattcaaatgaagtttaattttcatttattatacaaaaatgtcatagctcaaacccagaagtgttacccccaagcttggatatagacaggtatgtgtgtacattttacttttcaagatgaatcatagcagtcttctccattacatgtaaggactagaagttgtacattccactcaggtacctaaaggcaagcctgtgctagcccacactaacaaagcaaaatgaagcaaaggatctatctggctttcaatcagggatgcatctatgctatcatcagctctgtcacataataaatgagtctatagataacttgaactactcagccaatgggctgtaacccagtgattctgtggtattgaaaggcagcaacccccagaagccacatgtctcagtgtgcactccaggactgtaggcccatagaacttgtatgtatgcacacatgcatatgcattccccacttttctaatggcgatccaatctaggcctaatccacagctagtccagaaaagaacttttttaggttttctgtctgccatcactttgttgagaggcagtacaagccaagcaggtgtctgtatttataatatgcacaatgttaggataactcaaactcataagggaaagattaatggctgactactatgaaaaccgcttctagccttgtgataccagcacctactatcttcctttttctcttatatgatgaaaagatttcaatgttggcttttcattctgatagaatgtgcaagccaaaatctaaataaagtccagtggcaatgatccccttaaacattatatctttcttctcgatatgctgatgttttcccttataaaaatctatgtaagtttcaagatttatatgacagacaaaccacacaaacaggaggtccctcacattcactactagtcacttgctctatcactctgggaatagcggtcttcagattgcatctctactctacctcttgctcttttcaacccctctcctcttttttagaccatacagggcatcagacaaggtttagtttaccactaaactttgggatttggaagatggtgtataaactgatacaggtagtccactcacagatgtagtatataattacagacttgagttttcaggggctcttctccagtttcctgtcaatcaatttccctggctgagacattagcatttgtcagtgaccatgcttactatatacatacacaattgtgtatacacaattgtaaaattaaatacgggctttagaagagattattttttcttaagagtaggttactctataaatgccaaagcatgtgttatgacatagaaattcaaatgactaagaatagctaattgtttagaaacatcttacttgatgtctattgttccaaaatttgatccaatttagagtggtaccaatccatggtgtagaatataaaagctaaaggataacaaaaatcctaggaatctcatgccagtaagaaagttctaccagtcagatgagatgttgagagcatttatgacttggcatcaggaatattataagtaaaattcatgtgagcagtaattgcagctatgaaccatgttatttgttcccacttgtccaactgtaattctttcacttagctcagagtagttctttgtaacattagggcccactcatctgcctttaggtagggttttaaaagatgcctagaaaatagttctgtgctagaaatcagagactcttgacctactgtaaagggagcagtaagcacgtttcctcaggagaatctttctacatactgcagattcccataaaaatctttgtgacaaaattgcctttactgaaaccatcatccattggattaaaaaatagcttaccattagctttttgaaaatagaaaacgttgagccttttcaatgatactttcaatagtttttcacaactatgagtcctcaagctatcagtcttatttttagataccatacttataagatagttatagaatttatagagtatggtttaaaagactattcaattatagagcaatcattcagtttattcccatggcagaagtaaatggaaaccactccagatcaacaagaatctactctcttctgattcagaaaagagatttcctatcttttcatgaataatccatgttcaatgtttaacacctcaggaagattttcttaatagcttcttctggtcataaatccttggtctgtcatcagggacatattgaagagttagttaccaaagttcttaatgtctcccattgtaaaaaaaaaaaaaaaaaaaagtcactttttggattgtttctttcatagagtccatgcttctgtacgcttaatactttagcttttgacttcaagctttaggtaatgcaaatgaagctattacatcaccaaagttaaatttttcttgtaagtatattctcaacattcacaattgagagctgcctcttctttggctggtataaggttttaatttattgtagcactttcaccctagaatggcaaaaaatgttgaaatcaattccatatatcaccaatacaaagtactaagtcaaggccgggtgtggtggctacgcctgtaatgcaagcactttgggaggccaaggcgggcagatcacttgatgtcaggagttcgagaccagcctgaccaacatggtgaaaccccatctctactaaaaatacaaacattagccaggcgttcatagcgagcgcttgtaatcccagctacttgggaggctgaggcaggagaatcgcttggacttgggaggtggaggttgcagtgagccaagatcatgccattgcactctagcctgggtgacagagcgagtctcaacaaacaaacaaacaaaaatattgaattgtacaccttaaatgggcgaatcgtatggtatgtatactaaatgtcaataaagctgttatatgaaaaaaaaatgctaacacacacattctgaaagtatattaaaagcaaacctacggccgggcgcggtggctcacacctgtaatcccagcactttgtgaggccgaggtgggcggatcacaaggtcgggagatcgagatcatcctggctaacacggtgaaacccagtctctactaaaaatacaaaaaattagccaggtgtggtggtggacgcctgtagtcccagatactcgggaggctgaggcaggagaatggcgtgaacccggggctggagcttgcagtgagccgagatcgcgctactgcactacagcctgggcaacagagtgagactccatctcaaaagaaaaaataaaaataaaaaagcaaacctacaatgtctcttacaaacacaggcaactattcaattccgagtttacactactgaaacacacatgaatatgacactaagagaatcacgtggatctgcactcttcaatcaacactacgtctctgagcacaagaattttacatctgatttccatttggggaaatagattcagaatgccataaaccagatacttcttgccttcctttagtggtcatttctgccattatcatttaagggaatggatctccttctcccaaaactgttaccctaagattacaagcttgtcctttaacttatctctgaaagcacacctctataacgggtcatcagtattcagtcagctaattagactgcagaagtacgtttactcaaatgtgaggagataaaattgtgaaatgtaagaggaagaaagaatgtcaaagataatccaacccaaactcttcatcttacagataggaaaatggaagtccaaaaggggaaagtaattttagtaacatggctaaactggtctagaaaaccagatcttctgatacctgatcccatggtctttctaatgccatggatgttcgggtagaggatatattcaggtagataacttatagatagccccatgtgtttgtatagcactttatcgaacactttcacctctattatcacacttgattcttacaatatcccatggaatgtttgagtatcatatatgattattcttattcccacagacttggaaactgaggctttgagatgtctggatctatcttagatcatttgctatggactagaatctgggactaagttgcttttgtctaagctgtgtgtttgttctgttgtgccgtattgttaattcatttctgttggtaaacaacacaaaggaaaaacttctataattatgtttctttttcatcctcaggtcatctatcctactttttatctaagctttggaaaatattatgtgctttccttttttttgtattttcttttcgtagagatggcagcagggggtagtctcaccatgttgcccaggctgacctcgaactccttggctcaagcgatcctcctgccttggcatcccaaagtgctgggattacaggcgtgagccaccacacctggcctattatgtcctttctttagcttgctcgtttaaccatttgtttggcagggggagtcagaactgtgttttacttagtcgattaactgataggacaatttaatatctaccctgcactggcagtaacccccatagccccgctctgtgtctcattctgtgccctgaacaaccttgtcttaaaaacattttaaaagcagcaagtatggggagatttcttatctccatataatacagaagcaagtgtagagtatggctacggaaaacaaccagcaggtgaggctgtgacataacaattttaacccaagcctcactgccacattgaggtatccttgttcaataaatagatcagaaaatatggtgtagtttttccctaacgctgtctaaacagcaacaacaaaaaatcattacccatagtatttcagtaatgtgttgtattgaatgcattgttttcgagggcgttttcaaaaaataagttgattgaatctcttttttttgcttgaagaatgacccacattcagaaagtatacagatgaaacatgttcagctcaatgcaattatcacaaaatgaatacacctatgttcgccatctaggacagtaaataaaacattatcagtagccctaaaccagattacacacacacacacacacacacacacacacacacacacacactaaaccagactacacacacacacacacacacacacacacaccgggttgggggagtggtgagagagagagagagaaagcgaatattatgttaacagttggggagtctaagtgaatggtttatgggtgttcttttaacatttcaattggtttaaaattttcaaaatgaaaagcttgaggagaaacatagaatataaccactacctcagaaatcaccaccctacctcacccacattccctctcccaatcactattcctccctcatcttaaaggtaactgctactctgccttataacactatggttgagttttgcctgtttatttgaactctataaaaatggaattgtacagtatataaccttttgtatctaggactcaacattgtgtttatgagattaactcatgttgttgcatgaatctgtcatacattttcattgcaatttgatatcccatttaaaatgtatactataatttatccattctattgttggggaacattttggttctttccagtttgaagacattatgaataaggcctcctatgaacattctttaatgcgttttttggcacacacgtgtgtacaactgtgtttggtatatactttgcagtaaaattgcctatgttgagggtaggcatatgctgagctttagtagatactcctggttttccaaagtggttgtaccagtttacaccatcattagcagtatatgaaagttctagtagctccacatctcaacaatacttgatacttgttagtctttaaaattttcgccattgcagtgagtgtgtgagtagaatctcattgttattttaatttgcaattgtctgattacttatgaggttgaatatttttacgtgtatttattgaccattttggatatcctgttgtgtgaagtatctattcagtctcttgcctattttttttattgattcatccttctttttcttattgatctgtaggagttttttttacatattctagtttgtagccctttgtaaattgtatgtgttgcaaatatcttctcccattttatagctttccttttaattaaattgtttttttgattgatagttcttaactttaatatagtccaatatgtaaatttttccttagggttaattcttttgtgtcctctttaagaaatctttcctaatacaagataatgaatgtatcctcttttattatcttctagaaacttactattttttaacttttccatttagatatatagtacacctggaattgaccttttgtgtaatatgtgagatagagattgagttttatttttcataatatggatatctagttggcccagtacttgatgctaaacattcatttagaattcatttgatagtatttcctttagagttattgcatctgtgtttattagttatattggtctgccattcttgtcaaggtttggtatgtggattattctggtttcataaaggcaagtagggaagcattgcctcttctagtctctggaagagtttctttaagattggtatttctgccagtgatatgatttggccttggaattttcctagtgggaaaatttataattacagtgtttatttcttaaatagtacagggctattccaattttctatttcttcttttgtcagtgtcagttgacttaaagcacactaagatactctaagattgctatggtcagcctttgctggtctaaaccagaggttgcaaactgaaatgccaacagaggggctagcctgctactgtaactgggcaaggctagcgaagcgtaagttaatgggagctggtagggactatagaatacatgtgccgttatagaatggtggctccggaaagttattgtcatgcaagaataggagcccagcatggacaaatcattccttttaaatgagaagtcagaaggttggattattctgtaaaatatctctgaatatttaaatgttgagtaattcagattaaaaaaaaaaaaactgtgtgggctaatcaaaacatttgtgcatgccaaatttagcccaaagtctgctagtttgcaacttgtactttcaactaatgaaaagcgtaatagcacagatataattccattttcaaataatataattcatttatagttgacatttatttaatttacacttaaatatgaatttgtcatttaatttaccatattaaaaaagtttagattttaagacatccaagtctgcaaataactagaatattttcatttactctcatgtttgtgtacttatttttccttaaatgttattttcatgatatacttagtgtcttgtggacattccaaaaaactgatttgacttaaattgtcctcactccaagctttaaaattgcttagttcatagcctaccttgcctaaagcaaacctggtagtctcatttcaagttactggattttttgtttgtttgtttgtttgcttttgccttgtttcttttcaaggttatatagagtgaaggaatatcagacttcttttaatttttgcagggaattcagattgctgtggattaagatcctatatataagatgcttaggatagaggcatcatgaatgaaaaattattcatatgaacacactttttagagtattatttttattcattcagcaaataatcatagctgccatactaggcaggtagggaccatgaagactactgtccttgtagtctaaagtcttgtagactaataagatatgtataactgttaaatagtacactgaaaatacaaccttaaacaatcaaaatatttgcaaattgtatttagttgacatgattgcataattgtatttatgtgacaattatatttgttattcacatatttagggagtcaatatgtacttaaggtaatctttgagctattttcaggatgaggtattagctcattactattaatactaccatcaccaaatgcattacctacttatctgcatttccaggaaaaattcaggaaattaggatttttaaaataataaaataatagtaaataagactgggcatggtggctcatgcctgtagtcctagcactttgggaggccgaggcgggtagattgcttgatgccaggagttcaagaccagcctggccaacatggctaaaccccatctctactaaaaatataaaaatcagccaggcatggtggcgtgcacctgtaatcccagctactcgggaggctgaggcatgagaattgcttgaacccaggaggcggaggttgcagtgagcagagatcatgccactgcactccagcctgggcgacagagtgagactctgtctcaaataataataataataataataataataataataataaacagaataataacctaagtgactatatttgatatatagttaagtgatgtttttgtagactttactaaactaaaaaataaattagcagttatttaattttctagtttataaagtacctacttacataaagttgcatatattacttcatttaattttaaaagaatatcgtaaaatatgtaggatagatttccattttatagtcaacaatacttattatttcaatacattatgtgattttttttcccccagtatcacagtgttagagcccaggttcaaaccagcattttctaactgtaagtctggaagtctgtctgcttactctatgtaagatgccttatgaagttcatagaggagacagctcagtggattcaggcctggtcttatattttgctgttcatcttgttttaagtgttatgttaagcaaataaaacataactttaaacattctgtttacttttaaaatttgatttagagctaacaaaaattagaatttgtactccatttacaacgaacagaacaaccaaataagcaaaattgtatttgcgttgtcaattacaataaataattataatggtatatcagagtgttaaattttgatttttttttttttgagatggattttattttattttttattttttttttttttgctctgtcacccaggctggagtgcagtggactgcaacctccacctgctgggttcaagtgattctcccgcctcagcctctcgagtggctgggattacaggcacccgccatcatgcccagctaatttttgtatttttatagagatagagtttcaccatgttggccaggttggtctcaaactcctggccttagatgatccacccgcctcgacctcccaacgtgccaggattacagatgtgagccgccacacctagactaaaattttatgttcttatatttctttaaggaaagcaaaaatgttgacagagagggttaatactagttatatatacaaaaaacctaaaaataagattttggattattctattatatgattattcatttattgaaaatcataaactaattgaatgactgagagcagcactaatgtgattactttggtaggaatctgtcctccaaagttgtcagttgtcagttattcttagcattttgaactgaagtctatgtaattaagtcacctgttgtttctgacaaaatgagcaaacacacataaaatctcttggttcgtcttcatgtctctgtggcagagaactgaccacattattcagttcctttgtcctttttagacaaaagccacctctacatggccctataagtcttcaattcaaggactatagccgttatcttaatgggattgtacttggttatctgataaattgtcgggaacatacccacattgcttcctttacctgacataaaatttagtcagctggggctcaacgattgaccagctttatcttgcacgtagtgaagggaaggactttcttactcctggatgtgcctaaatttaagcctttgaaaaagattgaagataccaattggcctacctgccctaagtagatgcttcccacagacttaactggtgaagtgcttgtctaaggtagacagaattttttctttagagaggagcaaacaaaaacccaaaaatactggcgtgttcttttgatgttctatttcccaattgatttccgggttcacactactccacaacatcttactgtcccattgcatcttaaccctctctcctctcccgcccccactttttttttgtctgtttcttctgcttccaccgttgcttctgctctgaagcaatcattttctctcccttcaaccaagggtggaattggcacacagtcaattggcttgggagactgcttactgatctgtcttttttgaacactggaatcttgacactggttatcattttgaggacagcctggtttggatatttatctattaagaggaatccttaattggtgtctttgactggagtatttgaaggagtctttaattgggaggttttaaggcaccagaaaagattcattaggaatgactgacctcatgttatataaatgagaaatatttaccatttgctgtacacgtaattgaagcatgattatacataaaagcatataattaaaaaatgtaaataaatacctaaataaataaatgcctataactagcatggcaaaggattctgatatcagctttcaatctcttttagtagagactggacaaatcagaaaaagaggatttatacctgtcctcctatagattatgctttcttctcccatcatccagttttaattgaatctcctcattgtgctttctttcaatcttgagctgcacaagttgttttctcctgtcagagcttttaatacacattgacaagaattattagtctctatctgcagttgttccaagtgcaggtttgaaataaggagtcgtcatcaatgtgctaacgcgtgctacttttggtatttatacaaagtgcctgctgccagttacttgccacttagaatgtgtttttcttttcctctcttgcgttgtgggagtagaaggattctctgtttcttttggcagacagagaaattttcagattggggtctaatgaaagaaataggttccattatacagatgtacagatgttctaaggtcacgatacctcctataatattcttatgtgaaacctcctctttatgttcaacctgtgtacgttacacttatacatagcaggcatagtagccatcaatattagttactttaaaacccaggcctcctaggctgtggtttgtactaaaacatcatattcaaataaaagcattccaatacaaagtggagaaacagggacaggcatggtggcttaagcctgtaatcccaacaggctttgggaggccgaggagggcagatcgcttaatcccaggaggtttagaccagcctggccaacatggcgaaacctgtctctactaaaaatacaaaacttagccgggcatggcggcacatgcctgtaatcccagctgtaatcccaggctgagttatgagaatcacttgaacatgggaggcggaggttgcagtgagccgagatcacgccgctgcactccagctttggtaagcctcggtaacagagtgagactctgtctcaaaaaaaagaaagaaaaaacgtgtagaaagaaagagaggatctgattaagctcacaggaacattgcttctcaaattttaatgtgcatacaaattgtctgggaatcttgttaaaatccagattatgagccagtgggtctaaaatgagacatgatgttctgcatttctaacaggtgatgctaatgctgctaatctgtggaccaaccacactttgagaaggaaggaagtagactattatatttactcattcacttgttccatgataactcttaaaacagactggtgactttaatacaattcagagcaccaaataaagattgtcatatgccttatttttaacctatcgtcttatatcaaaattatctgataaacttcccaagtgtgcatatatattgtcattttaaataggtttcaataaaatgaagattcgtgagtaagaatataggaataaatgacattaaaatctttctttataatttatatttctactttcttttgaaagaatttgtagtggcttaaacataagagcacaagatgagccagtgacaggaaaaaccaagtgcatctgacatcttagcttattaggtctagaagacaacctccattacttggtagcaagcggctgggaatattggtgttcaaagctgtgctttcctgaaggcaaaaacagcatcaaaatatgaaaagctttttacttctggcatgagtgataaagatgccgatctgagaagcaggtgaaaaaacttagcttatgcttctaaaggctaattttatataagtgttcttgtccagctgttcttggtaagtccagctgctagttgaacaggacaggtggtaatccctgttcagtggctcattatcacccagaggctttgatctggctaatacataatcaatcagcttctgaatattaatattcttcctattttcatttcacttgttttacctaaatttattttccaaagttccagtatgtttttgttttttaataagatttttgatcatttatttattttgacataactaggctcatgatatgccagctggagtttattacacccctgaatcacaaactttttttcttccctctttatctccttacaagatccaaattgcaaaacctaaggataaagttctaattttggaagcacaaaagactgaaactattttagaggagagcgttaatgaaaatcaatatctaaaatcctcattttaagactgtgaaccctatagtctatacttctagtgtcttcagagttgtgatatgcatacattaaggactaagaaacatttttttaaatagtcagatttgggagcattagatatgtttgtagagggaaaaatcaatttatgataaaaattactgacaatggtttaatttgtattagttttgcccacttccctgttatctcagaatggcacctccatggacagtggaatggtcctaacagcctaaatatggtaagctttaaaaacagatggcttggggccattctgcttattatatcattgctttcaatagcataactgttcttctccaatggccctctttgttgtttgcttcattactggcacatttctttaatatgtaatctataacattaacatgaaaatggctctcaaatactattactttctccatctgtgacccagtactgtttatcatcatctaatgatcattcttattgcagatggccctctttaaatgtttcagaatagcattttaaagacattgagggtgcttcctacgtacattggcagactgaatgttttaatatcgaaaatctcggtctacacgatgtgtgataaatgactggagatgcaaggcaccagtcagttccaaagcaaggtgtaagagggacaggaggagagtgataaaaaagaatacatactttgcgtgtgtgggtgtgggtgtgtgtgtgtgtgtgtgtgtgtgtgtgtgtgtgtgtttaagccattagatttatctttaaggaagcattatctttaaggaaagttggagtaggaagaacaaaatttaatcaaaagaaacagttcttggccagaggaggtggctaatgccggttatccgaacactttgggaggctgaggtgggagcattgcttgaggccagcagttcaagacctgcctagtcaaggtagcgagacaccccacctctgccaaaaaaaagaagaagaagaagaagaagaagaagaagaagaagaagaagaagaagaaacagttcgttattgcagttcttaaagaaggagtttgtgtttcctttctgatcattcaccatggcagtgatacaaaggagtgatatcaaattgataaatgagttccctaaggctcaacatatactaaatgcctatgctgaacttccaggtttcaagtccctagagcctctctgtctgaagatcctatcaccaaggattctttgtcttcatctagtactttctttctcctctctctattctttcctcatttgcggatgcttgctggggcctgtcaatcaaacatagatgatccctgacttacaatggttggatttaggatttttttacttgataatgctgcaaaagtgatacacattcagtagaaaccatacttcaggtatccacacaacccctctgtttttcactttcagtacagtattcaataaattacatgagctattcaatgctttagtataaaataggctttgtgttagatgattttgcccaactgtaggctaacgtaagtgttctgagtaagtttaaggtaggctaggctgagctatgatgttgagtagattaggtatgttaaatgcatttttgacttagaatattttcaacttatgatgagtttattggtacataacctcattgtaagttgaagagcatctgtatctgggttggagcagaagtattgctagtaatgcatccatgagtcaactgtttgcttaattggtatgctaccacacatgtcttgagcttgttcatcccatggcttgccattgtgttggaaaggaaggtgttacagcattgccgttaataacatttctaaatgggaccaaaaacagtattttctttatctgctagatctttttattttcttctttctctgtatacgtgagctgttcccaaaatttagcacacatgttttatgattctcaacataacgtttatggtccttaacattaatctcatattagaaaataaatcatgatgaaggtgaaatatagaccaagcaggggcagttatgaggaccaaatcgtcagtataaaacttttataattaatattttcatgaattgatagcacttgcttcagagagctaaactcagaaaaaagagaaatattctaacctgaaaatatatttttaaaaactcataatttaaggtagggggcaagtagatttggccatattttgggctttcttcaccaattcagacacgataatgactacatttgtatcctagatttaaatttgctagatggaaaagaaacacataaatataaaccccatctgcgcaaacaaacataaccattcacattcttatgcaggattctggggtaggggagggctttttttgtattataacatagcatgttaatttttaagataaaatggaaatatttttgtgcttttgttaatttttatgttaaaaatgacattttaggcacctaatcaaattctctgagttctttcactaaagaattttgcctaatatttgattaaattcattattattaaagatcaatggaatttctttcagtttgaaaagttgaaaaaatgagttgacacattgattcatagaaaaagttatgaaatttgagaaaaattattgaaccaattttatttaaaatacatatagatattatgtgtatctgccttcattttcaggataatgaatgtcagtgttaaatgtggaaacattctaaaattggaaatcagactccacttggttcaaagaacaccttattttagataagccttttaaaataatgattgaaatccagtcaatccataccctcacacataatcctcatgcatgatctttgtttttccctatctctcctctaaatgtcctttacaaagatgagaaatgttcttcccaacacaaaattcctttgattgtatattagaaagaactgacactttgcagcaaggtttaggaaaagctaacgtaagtagagcttctctgaaaactgttttaccaaaacatactggatttactgctgttaaataatggatttttttttttttactatttatatttgctcctcattgaaacttgtaaatgactttattagtcttaggcaacacatttcattttgcattggataaagatgcttcttcagtaaagtgttcatttatagcattgagaatcttgaaatataaccggtgtcatcaaagggtaggaaggtagaggcacagagaagtgattaatcacttttccctccaatgaatgatctactgtcaagttcaataatcatatttcatctataaagagcactttgagcaaagcctgttttgcacacgtcattacatttgattacaattaagtataaatatatgcctattatttagctctagttaaaatctgcaaaaatatagaaggcttgtgggtgatgtaaattggagatttgcataggtttagggtacaatattagaaaacactgtagttttatttttgctttatgactaaaaggcactagctatgttatctcgtttgttcaccaaactaaaaaacaacagctaaaaagcaatgtaacaaatttcctctaaccttcttaacccatccactgctgtcgcatgactctcacaaatcagaaataaagaaccatttctctactgaaggtcatcaactcatttgagggccatagatcagtaaaaaataacttagtctgagacattcaaatcacttgctttttaggtaaatattttggcttttaaaatgacacaaatctgaccaaaatgttactcagctttatgggaacgggattcttttctagataatcttagggacgatcttaactcatattgtttttgttcagagactaggtctaatttgttagaagtgctgccatgggatctcattctactcaacaggagtgcattcttcttatccagtatccactaaaagtcactcctcctcccatgaaaagagttgccagtggaaaactcagagaaaacatgggaagggattggtgatgtcatataaggagattagaaaacatttttttaacgtttaaaaagtaaagagatgaattttaaaatttacaaaccaataagtttgatgttgatgagcaacaaaatcctggaaaatgacatcgtactgattattaatgattacataggataacatgctgctgggaatcagcgtgatactctcaaaatctgccatgtcacatgcacctcattttcattttttttatggctgcttgatggttagatgagaagactgttagagacagcataacttaggattttacaccacatttttcaagttctcttttgagaatattgggtacaagataaagaacagtggggctggctaataggctgaatttgaagctgattaaataatgacatctaaagaatgtcaattaatagatctagatcaacacaaaatagagtctctgtcgttggccctgcctttgcacatggctgtttcttcttcagtcatctcttaagctcaactcagccctctgcctgaagacctcatttggccagttttgcccattcattactactgtgaactctcttttgttatttttttcctgttttattctgagaatggattgagctagatatgtggaagttatgggaaagcatattttaactaaatattaaagaaacttttgtaatcgagctctccaaaaaataaaatccgccactttgaaaagcattaaactccctgtacagtagattttcaagactgaaatgactgtctcacccctaaaggcaatttctgtattggatgagaggatataattcattaacctttaaggtcacttgtgaatctaatgttttgatattttcggaattaatcagaagggaactgacagcatgacctgaatctgtcctatatttatgtaaacatcctgtgtgatgcacctcattctttgtgcagttgtatgcatttttgaatgttaaatttgattttagggcaaacgcttttttaaaaaaattttaaaataaactttattaaataaaaatttacacacagtaaactgcctccatttaaagtggttcagcgatttttggcagatgtgtacttgtgaaaccaccactgcagtcaaatgacagaacgttcttactcccccaaaagcctccttgtgcccctttgcaggtcatttttcctttcacccctgattctaggcaaccactgatcgtctttctctcactgtgtattactttgcattttcaagaattttctataaatagaatcatacagtatttttgtatgtatctggtctcttatattcagcataatgattttgtttccagcttgaggatattatgaataagactgctaaaaattgtatacttgtttttctaaataccccttataaaatcttacttttgagaagcatattactaaaataacttcccaggttatatgtgtatttgttctttctgttcatttcagcattatcttattaacaagcaactggaggacatgcaccaaggataaattgactaggtgctaactgaatttgtgagaaaggcctagtttctaacgttctttcttgggagcagatgtgtaacagctacttttgctgtataacagaccaaccccaaaacttactggcttaacactgaggtcagcaaacattttctgtaaaggacaacatagtaaacactataggctttgtggagcactttgcatctttgttgcacattctttttctttttacaactctaaaaatgtagtcatacttagctgagaggctgtacagaagcaggccatagaccaaatttgaacaatagttcataaactctataacacaatggccagccatttacttagctcactatttgatgggtggattgggccatttatgtggtgtgaccagttgtactactgtttgccaggcatgcttatgcatctgtagtcagctggcagctggataagctatcgtgacctgactcatatgtctgatggttgacaggctgtcatctaggaacagatgcaactaggtttgtgtgtatctcatcatccaacatgctagttcaggctagttcacatggaaacttctcaggtttctgcttgtgtcatgtttggtagtgtccattagccgaagcaagtcatgtcatagggccatcccagatgtaaggagtggggaaagactccacctgttggtgggaagagatacaaaggcacactgcaagagctggacaccaaggagagggctagaacttttggccatgttgcaagatatcacaaaatattcaagaaaagttacaggaaggttcctctgtggactaaattctcttctgaatttagatgtaggtaaaatggagtgtgctgttaaaattcatgctttgtgagtaatcattgctaggctaaactgtttgtggcttcacagccaatggtagacatacagcatccataatctagtgcttttaaaaatataagaaatactgattacaaacatagttaaccacttattagtactgggaatttaatgaaagctgctgtgattaaatactgaaaaaagaaagattgtgggtttccttctggtaactttcaaagctggtcactcttttgaaaggaattttattcttaaagctgttatttttactcataatatgcttaatacccccatggctgcagactgtctaaaatgttcctacaattatatgagaatacttttaaaaatcatgataattatcagtcttcatggacacttattcagattaatttccccaagcacttaataggatgaatttataagcattaaatagaatggggaccatccagccctaaaatgtgaccattctgtcaggcacacacttgccaatttgttggcgtggacctgagcacactagcaaggactttgaattaggtctcactgcaagatggaagcagaagggcatttctcagtttatgttttgaagtgttttgttcagacaggcaacgtgcagttgtgtatagtagtgtgagctacctgttactccccttaacaatacttttagcagcaatgtttttcctcctgcaatgtgacaatatcaccatgccatttggaagaaaacaaaaaggctgagtgattcctggtatactcccaaacagccacccaaacgaacagctggcagagaagacaccccctaaaacttggagcagattctcagcccctgcagcatctcatgtggttagaacttcagacttgatgaacgcctccccaacttgctccccctcctgaatcttttaatcctcctccagtctcttgtaatgttccagcccttaccagggaataagactgcaaactgtcttccgtcaacttctttccaaatcctagtctagagaaattataatgatgcatgattgtccagtgggcatgtatagtttgtccatttctttatgtagtaaagcctgtagctttcatcttttttgccaatccactataaaaattaattttatatgtcatcctggtacacacacacacgcacacacgcatctatatctgtaaatctttttctgtctattcatgcttgtatgattgaaagaaaagtttcacaaaacattacttacccataccaaatagtacactttcatattttttttttttttttaatttcaacttctattttagatacaggaggtacatgtacaggtttgttacatgggaacattgcatgatgctaaggtgtggggctcatgacctgttacccagattgtgagcatagtacccaataggtagttttataacccattttccccactccaacctctacactgtcatattttctattcttttctgtttcattaagaacaatactggtaatgatccactatatagatttcatgacgtactaagggttcatgacctgcagtttgaaaaacactgtagttagttttatctccacctcaggccaggtcatcagaaagctgcattcttagaccactttgccttggcccccataagattgcctcaactcaggtgtacctcggcatcatgttcctggcttatgtcgaggggcactgaaaactgctgaagggatttttctgaaagtcgacaccatgcagtgtctcccaccttagatcccatgcagatctgtttattcaatctaagtcattccagacttggattttcctttgtttcacttacactctttcctccttatcaataatccaaataataaaatcgatcatatttccttttatattttttcttttgctttgacatctacaaaggccacaaccaaattatacccaccttttaaaacacttttttactgaaatatattaggcatgtagaaaataagggagatgctggttaaaggatatgaaacttcggttaggaggaataagttcaagagctctattgtacaccatggtgactataggtaatgaaaatctagtatagtcttgaaaattgctaagagagtagatttaagtattatcaccataagaaatgataagtatatgaggtaatgcatatgttacttagcttggtttagccattccacagtgtatacatatttcaaaacatgttatacatgataaagatatacaatttttatttgtcaattaaaaaaaaagaaaaaatggcttaaacttatacagttcagtgaattttcacaatctgaacacactcatttaaccagcatccaaataaagaaacagaacattaccaacctttagaaggccctttgtgtgcccttctgatagttacctgtcctccaagggtaaccacaatcttgattttgaacaccattaaatattctggcctgttcttgtcctttatataaatgaaattgcacagcatgtactcttttgtgtctgacttctttaaacctggattcatccatgctgttgtatgaagtggtggattgttcattctaattgctatgtaatatcccattgtgtcaatatcctgcagtatattatatactctactgtggatgggcatttggtagaaaaaaatgatgttataaacattctaagacatgccatttgatgaatatatgtatgcattcctttgaggactatatcaaggggtagaatttctgggttatagggtctgtgtgtgttcagcttctgtacattcttccaaacagttttccaatgtggttgtaccagtttgcactcctactaacagagcatgagagttgtagttgctccacatcctttctaaccctgtgttgtttgtcttgctcattctggtgggtatgcatagcaaaattttcataaccacatcatgcactgtgatcttcaaagctgtgttctggctgggcatggtggctcacacctgtaatccctacactttgggaggccaaggtgggctgatcactagaggtcaggagttcgacaccagcccggccaacatggtgaaaccccgtctctaccaaaaatacaaaaaaattagccgggcgtggtggcaggcacctgtaatcccagctacttgggaggctgaggcacgagaattgcttgaagctgggaggcagagtttgcagtgagccgagatcgtgccactgctctccgacctgggtgacagagtgagactccgtctcaaaacaaaaaacaaaaaacaaatctgtgttctaaattttcctcgcttcttaaagttttatgctatttatatttccttagtgctgggttttattaatttttaagagttatacattgttataagttgccctaaagcctttacagaacaatgcacagtataaatatgtacatagtatatacacaaatatgaatccatgaatgcacagctaatagggccattatcaaaaatcctacacttttccttttcctctagccctcacattcaattggctcaaaagtagcattgattttattctataacctgtcatgaattcagcctctccacaaattcccagtgctcctttcttagttcagactttcatccactcttaactgggctgttgtcatcatctacttggcatacatttccattctgatccctaccctcttttccacccttgtttcttcccacctcaaatttaattctattttaaaaagaaagatattcaaaagtacaggtggtgccaattttttcttctctatccatcatatgcaaagaggcttccaattctttgtcgacctgtttctaagggatgagagtaggtcaagctgtgaggacttcaattcccacgtgaaggtcttgttcatattaactcaataatgtgctttgatgtcctaatggggaaagtagtattttctgccagttagccttcccaagatatcaaatccaatattggccaaatacatttttgaattcctaaaaagcctaaactgatgtcgtaacacagctgtatattaacataaaaactctgtaccttagtaaattattaatatgagcgattagctcacagagtcaatgtaagaaacttgtttcaactcttcatattctagcaaaaagaacacacacacacacacacacacacacacacacacacacacacaaaacctgatttaagaactaactaggtgattaaagcctacttagtttttaattgaagtgcatattctctaatcccaagaggccaaactaatcacctttccctttttgctgctttttttctctctatttctgtaattattataatctgtctgatactgtgtttagctatatatgggtctatcttctctcattagatcataagctccttaaggaaaaggccatatttccttgggatcccacttaaaaaaaaactggattacaatgttgaaatttttatatatttccatgtcattctccaaacactccccagtttttaccaaccataaagaaaaaatgagaagagtttaaatgataagcaaatacatatgtaagtgttccataaatacactatgtttgaagttatttaaagaacttaatataggataatatttaatagagaaacttagtctagatagagcacataaaaaacattcttggaaatttgtggataaataaaagttccttgcatctgtattttcctttcatcttgaaaacatgccttgacaaaagtaagccagagctggagtacaagattcagacattggtagatcattaattggttaaactggattttatcttatttccccttttatggatccctgtctttgtgtggaattcctgccacttgctggctgttcaaggcttgccaccaggagactttctccatcaagctaggggatatttctccctcactgtcccccaccaaatcaatattcacttgctctctgactactccaggtttctgctgtctgagaatatgaacatggatataccttttaacatgcgtgaatactattcatattttaatctcggccccactgaatgatagcaaacgctgtgaattttatgcctatctcaggctacagctagtgccttatcttgcacacacacaaaaaaaatcttacttttcctacttgcttccttcttaagtgtaaaaagcaaaaagaggaaaggtgccttttgtaaactgctaaagagcagtttacagaagagcagtttactaaactcagacctctcattttccctcacacgacaatctaaaacagaatgttaaagtgaatttatttggttctgtatacctaactattcctgaacatactgagttctcttttaagaaatcatacctgcctgacaggctgctttgcatgaacacagcattccccagccttcaaattgctgtcagagccgttgtgtcattttgacccacaatatggcagtattatccacattctatagatgagttaacaaaagcttccaagtggttaagtgacttgcctgtaaagggttaagtgacccacctctaaggggtagaattggtctggacactctgcccctctatcttcatgcctttgctataatacacagctacgcttgctgaagattaaggaagctgcttttgataaagcgtgattcttgtagatattcatctcaggaaaaaaaaaaagaaaaacgctggtgtcttcatctgtagcatttgattattacattttccttatctgtttcaacttaggatgacttccttgttcgcttaattgactggtaattcctttgtttacttttttccaaatctcaagaagcaagtctagagtattaacaatggttacattagcatttaaaatttttttttgaaatttgagtatttcagaaaggggtaatttaggcaggcatgtatgtagaactttgcattttaattaaaaagactcaaaatgaaatgaacctctgacagtaacagatgactacttctaaaagctgcattactacttgatatatgctcagtattttcttgtgggtaagtcctacgacttgtttcaagaaaagtgacaggactaaaacaattaaaaaagacaaagctgctgttttttaatcatatgttcataaataaaactaggttgtgaattgtttccagagaagcaattgacaaagtatgagtaaatcactctaagaactaaagctgcgttgattttttttaatgttcaaccaaacatctatccttgtccaatgatgaattttctttgacaaataaatatttacaaagtatgaaatatagactctgtgcctttcctaaggccaaagcatactgtttaaactaaaatttaattttttttctcacctcaaatacaccaaaataagaacataactaaaaattaattctctcttgtagtagactgtccattaatcttttgttagataatattagcattgtgagtgtcaggtagaaagaaaaactgtaatttctagattgatcagaaaatgtgagtatttatggatttgaagaaaacaataaagtctgataaaatagaattttctgtaacctcccttatggagtcaagaaggaggaatctttcaacatcctcccattttgcagtgaaaagtcttcatgcagtaaatagtttgcttgggtagatcaaagggttaatttacttctgatttgagaagagacgcagacttccctgatttttttacaaaaatgtgttgtgtgggaggaaggtagaggcctcagaatgaattcactaattggggttttcacctgctgtgagtctaatcgaatacaaagccttatttgtagctgaagaggaagagagattatgcagagtgtaagaatttctgcccagttttgaaattccgcttatttggcacaatcggtggggaaaggcagacaaatagttacaagtttgagctgttaaggtagaccaggaatgctgtagtcagatatacttgaaccacattaaccagtgatccatttttagcaggaggtggtgtgggtcatatacatgggttatcgctatagctggcaggctaataggtactccaaattctttcccatgaagcaaccgtcggcctgtgaggttaatgaagtatggctttattttagtgaagatgctaaaattcacatctttttagatgttcggcttgatataggtggctctgtgaagctttgagaaatcttattaaaagaaaactgtgtgagagtgaagcagagctcgactttatctggaacctgtctggtgaaatctctggtttagatggcagctggctcacagagaactttcctgagtctggcttactctgcctccctaaagagacagggcctggaaaaataggcttttgtgtgggtgtgaagtgctctgtgtctgaacttagaggcctcttcatttgctggttaatgtgacctggctggatattcttacatccagaagatgttggtttcagattgatctagggggattgttatatatatatttcaattagtatgctataatatttgccctaaccagcaatgattcaccatacaccaacccatttgttagatgtctgagtcactgttcatggttagtacttgtactatgcaaagaggaatatggaattcttatgtctttattgtatacccaaatgctgacattttactatagaatatgtattcgagttaattgaagtgatacctatactctaaatgaatttttataaagtgatgcaggttatactaaaacttagggcgcactatagatagagagaagctgaaccctaggagttggtgaagtctctcgggaccatccctccaggcaagtacccagttcaaaccattccttgtctttgtcctttcctatgccactctgcatttttacacagctagcatcaggccaacattgaaaccacatgcaacccagaaaggaaaaagatgtgtttgtggaaggtaggaacagcctagtttcagctgttggcccttcacagcctccactagatgggctcattcgaacccaagacccttccaacagtacactgcaaatccatagctccaattcagacatcttccctctgagctcaagactcagatgtccaactgtctcttggatacctgcacttttacatcaccacctccaattcattatgttcaagactggattcatcatctctttcctaaccctcttctgccccctcctcctgaaattcctagctcggagaatgctactcatccaatctttgttgtcactcaaggacaatggtccttaaccttcactgcatattagaatcacttggagagtcttagaaatcctaatgtccaagaccaattaaattagaatctcagggtggtgagacccaaacatctaaatttattaacaatccctgagtgattccaaagggcggccaagcttgaggactattgctttacttcttccctctcttccattcatacatccagtcagtcaagactcctgtagttggaaccttattgtatcatttctccacctcctctgccactgctgtaattcagatcctcctcatactgcaatctccttgtacctgatgtctgaatttcagactcttgtcttctgatcaagcccccataccattgcctgagtgatttttctaaaagacaaaccggacagagccacactcatgctttaattctttcttccttaaaaagctccctcatacctttcaggatacaagtcaaactccagattgtcacactaagccctttccagtttgcccatttctctaacccttatcttgacattctctccaaaagatcaagcagaccgttgaagctcttgtaaagaacaagctggttgcatcctttttaccctcacatctgctgttgtcaccatcataattgttgatatgcctttaccctcaaaaggccagaagctctttgtgggcctacagaggaggcttctctgaatatttatccaatgactgagtctcatctgctttttagccccagagtggggggatctgactttctcctctatcagtagtccccactcagcatcaagtctattgccccagagggtggctttggctggatgggtctcagtttggtcagggtcctgggagaaacagatggtacattcaaacggaacacttgaagagagtataatgaaaaggctatttacaaggctctaggcaggctaggagaaaaaaaaaaaaacaaggaatggtaaacttttgcccaaagggataaagggaggaatggtttgcgtaactggtggaatgctattgctgtaggaaaggactggccaacaagacttgtggctgcaggtcaaggaactcagcagctgccaggccagagatcagtaggagggaacctgaagaataaatacccaaacatcaccttcctcctgtcctttcctctccttctgtaggcctttcatcactgcctcccaattggctgaaagcaaaaggaagccaaacggcaggaaagcctgattgatgtccccacagaggtccaacctcctgggccacagagcagaatggagaaggacaaagaatagagatggatgggagaatggggaagcatcctgcacagtcccttaggtcagagatgcccttattctctaaagataccctcaaagtttaagtggttcaaagaccagagttttggctacgggaaaatgtactgggtcgccttctttgacctcatcccatttcatttcttctttatctctatttctagcaaatttactcttctctgctctgagccatcagtgagattgtctatgagtatactagaaaaaacacagacctttctcacaggaaaagaagccatgtctcttcatggcagcatagcagaatagctaagcgcatgagtcttcgagctggattccccaattccaatccttgcaccattctagacagtggtactgggaacaagtaggtcatggctgattctgaagtcaaaattttagctgaagtttgttctggtagcagagcttcaggctcttttcatgtccgtggttcatatcaaaacagtaataataataataataatataatcagaaggaggagaagaagaaacatctactataaacaaacaatatattatcatacatggcatcactacataatttacatatgacacgaaggtatatcaattatgttcttttccaaatgctttcctctaataagcaaaattcataatctgactgcaattgaacaacaaaacagtctctgtgatgcccgcgtcatttcttaatactttcagtatttaattataatatgacgtcaagatttgggaacaagtcttcaagtgcctataactccagtctaaaaaagaacttaaagatgtatttttgaggattgccatctgtcaatttttttaaaaagtctgaatagtgatttcttattccattcttttttcttgtcaacagattattcttagtagttttctaattggacactgagaaaagagacttaagcatttatagagaagcgtgtcagaactcctgaattttgagcaggtaatttaaaagtgtaaaacaaacaaacaaaaaacaggaaaggaagagagtgacaaatgtcttactatccaggtgttacaaatccttagtttatcgatttgtaatatttacaaatgtccatgctctgaggcttctgtcttttcgttgaaataaacataaacagtagttaagtgatttgccacactgacacagagattggtgtctctgatttactgcaaagggcactacttcctcattacaggacactaatccctcttccccaaggatcggagcagacctagaatatactattagaccaagggacaacttcagccaaagcaaatcttagtgtgcccccctcagaccgtaatagcagctgcctccacaactcactagcttaaaattgctaaagggcaacactaagtaatctcagtgtatgagccagaatgccagaagaagtgccatatttgcttaaaaatagcaataccgatcatacttacatgcacatatctttagtgataacatttacctttatatttggtttgttaaaggtaataaagaatcctggcattcccttttgcttttgtccagatactttatttttgcctcttttgccatgctatagcattagataaagcaaaacgggtgtgcttccacctaaaacattctagggggaaaaatgttgagcagaaaaggattatttcaaaagaagccggatatggtggcatgcacctgtcatcgcaggcacttggaggctgaagtgggaggattgcttgagcccaggagttgggagaccagcctgggcaacacagtgagacccccatcccttaagaaataaattttaaaaaggggaccacatttaaactgtagaccgaagtggaatgaatcaatcggaaaggagagtggaaagcaaatgtttgaaagaaaataaaaagaaaagcaagccaacaaaataaatggacaaagaagggcagtgaaaatatcactaacagtttatcgtaagatgctctttggatgctaatctaaggtgttatgtgaagtttgcagaaaattcttgtgctaatgaaggctttcttcttcttttgagtatttccaagcttgaaataattgtgtgtagttaacttctatcatcatactgcaaactctaaaattagaattatttgaactgttcaggccctgtaacttttccaataaaatattctattagaaacaagttccttctagatcttcctaaaagaatactaaaggaccaaaccgtgcaacagcactggtggtattgtcttaatttagagagtccataccagtgattctcaaacattagtatgctcagagtttctggttcaataggtctgggccgggcccagggaattttcatttctaagaagttcgcaggtgatactgataactgctgttcccagggtctacattttgagatccgctgctatgtcacaaatccaaatccaaagtctttttaacaatcccttttagcccaggatgagcctaacggcaatttcacgtccttatcgccggccactttaatcttcaactgaggaggaagggagagtgagaattatgtatataatttttttcttttattttttaaaaagaaaactccaagcccacactcttaattatctgggatgaggtcatttgcacctgggtcatttatttagacaacaagtagtcttgctagaggctttaaggaggtgttagcagagcggtgtgtggcttccaggttcctgggtctaccttaaatccccatcctctttctttctttctttctttctttctttctcttttctttttcctttccgttttgaaagccccaactgcccagtctctgggtgtccgggttcccaggtccctaggtgggggcggagcccgacacggccccgccccgtctgcccgcagcgccccctccccggcccgcccgcgccggctcctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaagggtaagtggatcgcggccccggccccgtctgatggccgcaatccgtgcacttgtggcgcgagcagggggcaagctgaggcggtcaaaacttggacaggcgcggcggctggacccggggcgccgggcggctgggcgtctaggaacctctcccgcgggttcccgcggcgcggctgcaggtgcgcccccggggtttctccccaggcgccgggctagtgggggaacctcttccctcggctttgggacgggctcggagagaaaaagctgatttctccccgtccccagaggggataacgcgttcctcacgcggggattggggccgggggagcttttcactcctttccaggctgccagtgtggacgtgagcaaggctggctgttcctaaatcgtcgctcttactcgtagaaggaaggggcgcacgcggcgctaccttccattgcactgcaagtgccaaaaggtcaactttctgcctgatttcttccgaggattccaactgacatttccctcgctgcattttctaccgtgctcattccatgccccaagacctgcagaaatcaggaaagaaagaacaaacaactaaagcccagaagtcaaagatttcagggggtggggatttttgtttgtttgggcttttttttttttttttttttttttgcccttcgggattgggtgtggagtcatttctagggtgttctctcgcatttctccaggtgtctgtgctcatcttcaagcaaagtttgtcactcccaatcccagcacggcaataaaaagggcagaacactttgcttatattagtcaaatttgaagttaagtttgaagctttaaattgaaggggtttagttgctcgagggaggcataatattaattataaactgtttttacatcatgaaaaaaatccatccgatttaagtggtgaacttttaagtggcgtctttaagtgaaatctacatttttccttgggcaataaactcttcttggtcttctgctttatccctgtcatctctccttgtcacccaccccccccccccccacacccccaatcaacctttctttttttgcctagcttttttattgccttttactcaagcccctctttggaggatacatttgctgttggagaagcgagtggagcaaatgaagcaacacggttatatgaaaggtctctgacccttgaacaccgtggaattggtttcagtcatcattgtttgatctccgattggacacgaccctgaaaagaaattgctttgaccaaagttgagggtgggtaggagttaaaccttgaaaagcaaataaaacggaggacaactaacagctggaacagccaccgaggcaatcatctttgccctggctttagccagacagaataaaatggtaaatatcccagggaacaagaaatggggaactagaatggatttctgatgcttatattgatgcccacccctccaaacccctgccccacggtagcagaaactttaaaatatattttaccatccacaccctgccagtattccagcaatgcaagccaagttcaacaattcagcacgcaaatgccaaggttcctctagaaaaagagtctgatcctcagattaaagggaaatcatttgtgtgtgtggatcaatgggctccagattatatatgaaaccaaactctaatcctctgcaaatcgcaagagaacgctccctttttatattgctgcatagcgattagttttctccctgggaagtagtggacagatagttttttaaaaaggcaactgtttggaatattttcagtaccaaataacaatggtggcagaagaaatcttattttaattaggcaactgccattttcccagccacagcagtagatatttgttactttttataagtgtttaatgtttgtttttaagaaactaaaaaagcaattccaataagtctgattattccagcactgacagcaggaacagctctgaggcagttataataaccttgcacactacttgaaactaaagcaggtgagagaaaatttaaattgtatggtaggaaattaggtcagccttgtgctcagtagagtaatgctttaatttcttattattgacaagtaggtgttgctggggtcttttgtcatagtcgatgactttatattttaatttgcatcagggtcctatcaccgcctcaaataaaagggaaaaagattatcatggtttgtagaaagaagaaggagaggggaaatcttcgtataaatactgctcagagaggcatatctgatgccaggctttggaaccagcagggccaaaatcaataacattttttaaagatgtaaagagcgttttaaggattatttatgaagctgatctctgtgttaatgtacgtacagacttgtgatctatgttgaacattgttgttctcagaaaggccaaacaaagatgtacccattaacatgtgaacaggtttcagaatttcccttttggttgttcatggtatatggggagtgtatttccgatgtggagagtgaaatgcagaaaagagacaattaccaaaacagtgccacccacccttccactccctcctccctagcacaccgtgtttttctatatcgtctgcatattccaggtaaatgtgggctcttctcatggagttactgagaattctctactgttttagaaggcaggcacagagtaagaaacgaagctgtaaaatcggtattgatcacagacaaaaatgtggtttgtccttcaaggtacaagatagatatgagttatgcagatttgtgcttacagtttcatccagtccatattcatagttcctatctattttggagggttaaatgtgtcccagtggggctctggattcatcacaggtagaaaataacaagccgtgaagtgaatatttggttcgtcatatagttaccaaagaatctgaaggttttttggctacgttgccaagcatttttagcattaaatgattaaaagactatttttctcgttttaagaattagtcacaccctttattcttttcttctttccacttgtgctcacttcttttgcttagaactgatttgcaattgaagtgaaactaagactgcaaaggtgaaatctaaatctgtttttctagttcttttgcattgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttgaagtccattccagatggtggcttttcaccgtggttccctgtctctgtctgatcaggcttatcagctcagctaaatgtttttctgcagacctatagaagatgctacggtccttacaaatatcctggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaacagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcaggcttgctttaaatttcaccgccagtagggcgcagagccctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaagacagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatattgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagttctgttttctttcccctcataacttgaattattttgaatgggtacagagcatacaaataagggtttgaaaacaccagtctttttacactggacaaatgtccagatgtctggtttgtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaatggttttattaaacatttttctaattataaatgattaaatgtcttctagaaaacctgaaaaatgtaaataaaaaacatgaaaaaggaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaatagtctaggatcttcaaaaatgtctttctatacatatatttttatagaagttgaatcattctgtcttataacttgctttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcacctttcagagttaatatttccaatagttttgtaacaatcaaacattcgttgggcttttatccaagtggtgattcatcagataacatctcccatttattgcgggcctattgtatgttttccacatgggatgtgccagcaaccaacctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccaccttggcctcccaaattgttaggattacaagcgtaagccacagcgcccagcctgcctacatccttgagatcccatataagattaactaccagcactgcctttccccctctccaaaattacagtgtttcagagtcgaaacataagcataaaatactgaaaagaaacttttcattgattttagtttttacttattagtttatatttttcttcttcaagaggtatccctttaggtccaaattgctctttgagctggatgaaatggtcggaagccttcaactacagtcagttggtgaaaggtatcttgaaagcagaaatggtgttgtggtctggcgtgtcaaatgtttaagaccacatctagccccctctcctaatcgaacctgaacctcatgtctctggtgaggtgctgaaaatatcaagatgttgctttttccctctgtacccccactccaggcatactctaccgtggaagctacagtggttcacagtatgcatggtaggttacacattcctagagacgcccacttctaaggagatttccattctctaatttgccaaagttcccaagcagcctgttcaacacatgtttatgttacctgccttgccctcaaaagcattcaggtgttcccctgcacccagggtttgaacacaataggattagaaggtgaaaacattttgttagaactgaaaaagtagcaagtatttactgatgaaaagctataatattgcttgagatattaccattggagctctctaatacattctgggtggttttctttttcattccttttccactgattttctacaatgaatttatattatttacagttagatgtttggtaaaaaagtttcttcgtcgatacccccattccatttcttacttagtgtctctatagctacaattcattaactaatgagaacttatgacagaaaagcagcagtagccacacacacacacacacacacacacacacacgccccacatatatgtagataatttatacttaaggaccctgattctcatggactttgtcaggtaactttaaactcaaagagatcatctcatgtatttttagtctgtatgtccagttgtgaaaaatgcagatgtagacattttagtggtagagaaaatagaacttttttgattaaaaaatagataaaaaacaatataagataattaattttagattatttccaacagatctaaaatggctttgcagaggaggtttccatcaagtgttagaaatattgtgtttccctcatttatcggctgtgtacctacacaaaaaattgagagaaaatattgccagagtcctacacaaacaaagcaagacatagtaaagaaataatttaaaggttcactatgatgactgaacagtcattaggaatttgagtccccagaaaattttttacatcacattaatggtttgacaaaagcattgtcttggattttcacagggaataaatcactaaaagcaactggaaatcagttttctttcagcatttgtctgtgactacccccaatagtcatagaatggtagtagagaatagtagtggagtaagtgggatataagagaccaagtgtctcatgtctattttttgtagaccttggtgctttatctttaaaatgtgaggatattggggctgggcacggtggctcacgcctgtaatcccagcactttgggaggtcgaggtgggcggatcacctgagtcaggagatcaagaccttcctggctaacatggtgaaaccccatctttactaaaaaaacaaaaaattagccaggtgtggtggcacatgcctgtaatcccagctactcaagaggccgaggctgaagaatcacttgaacccaggagtcggaggttgcaatgagctgagatcacgctgtagcactccctcctgggcaacaagagtgaaactccatctcaaaaaaaaaaaaaaaaaaaaaaagtaacgatattggacaagtgtctaagatttttgtttttcttttactttgggctgagggtggggcaggctgtttctaaacttgctgtgatcattatttttcaagaggtacctttcggctaactctgcagacaagtggatttctaaaaatgtaatcattcctatgttttaaaatgtacattctgagaaaacaaacaacaggagaagattatgccacccatccgtgtcttacaggctgagtgaggcaagctgttgtcaaatagagaggctcttgagatatttcccattagactcctctgggtcattcatttgttattgagagggtacattcttcgtcactccctagaagtaataatatgtttgattcatgaggtgagttttagatttctattagcatttttacaaatgtaatggaaagactgttccaataggttagcttggtgatttaaaactctgagctcttcaaggctccagaaagcatttacaacatcagtagatgttagatagtaatatgctctggaatttattttgaaatactaatataatattgatttacatgaagtgcaattatgtggttaaaagcctgtccttttctcacaatttatgtctaggtccctaagttcattactgaaattttaagaaaatattttttaaaaagctcaccctgcccccacacacataatatatgctgcttagagatacttttattggggtttttttttttttttttgacagcatcttgctctgtcacatagactggagtgcagtggcctgatcatggctcactgcagctttgaacacccaggctcaagtgaccctcccacctcagccttccaagtagctgggactatagccgtgtgccaccgtgtctggctaatctttttttaaattttttgtagagatggaggtcttaccatgttgcccagcctggtctcaaactcttgggctcaagcgatcctcccaccttggcctcccacagctctgagatcccaagggtgagccactgcacctggccttcacaatttccaatgtcaaatcttactacaaatttaagtaatcaagagtatttacatatggacagatatactgaccaacagagtagaatttaggctgggcacagtggctcacatttgtaatcctagcacttttggaggccgaggcgagcagctcacttgagctcaggagttcaagaccagcctgggcaacgtggtgaaaccccgtctccccatctctacaaaaaatacaaaaattagccgagcatggtggcatgtgcctgtagtcccagatactcaggaggctgaggtgggagggtcgcttgagcccgggaggacgagactgcagtgagccgaggttacatcactgcactccagcctgggcaacagaacgagaccctgtttaaaaacattatttcttagcctgtcttattgggggggggtctcttaattataaatacaataaaatatgtggttccccaatggttcctttttaaattacaatgtgagtttttttgcatttgtgatactgtcagtatagtacaagaagaccagtttatgaaggagacatgtaggtaaaaataggataatgtgaagagagaatcgctgcacttcagaaagctgattttatttcaagcagtttattaaaatctagatgcaccgtatgttctggtgttacttattccaatttccttttccttcattgaagccctcttaaccacaagtgttttctcaaggggtactggttttccttttcttaagttatagcgttcttcagaaggatctagccctttttaatctgttgcccaatttttggatcctactatccagcatgatgctcacctgaatgatgcgaaagctctcaattttcaaaaatggacttctgagtgtttttggaattcttaggaaaagtggtctttaaaaaccataagatttgaaggcagtctatcagcacgtagcccttagcttcatgtctatggtttgcagagagcttcagaatgttaaaatgagggtttaattttagggtctgctgggcctgaggttaggggtgtgattcttcagcagttctagttaggagaactagttaagtcctagttaagtcaatggggctaaaagctttttaaagatacatcaatatcattataaatcagcaatttgcaagagagttaaaaacactgctatcaaaatccttgtacctctttcctcagcttgcccaagaggaagggatattgtagttatttgttcactctcctcttttgataggctttctacattccattaagtattccctcctgaggatgctcttgggttagaaactgcaggattctgaatgactatgaattccttccttttgcattaggagcttgtcctaatgcttttctcagcatattttgtgaactaaactgttctccactaagctactcaatatttagctttccttggctcttgcttctagttccttaatatattgctcagtgttaaaacctctgccttttgactttttactgccataacgctttgaactggaaaggatagctagattcagatgccagctttggtgtgacctcgggcaagtcccttgctttctattggtcttcattttcttatatgtcatgttggccagtgatctttcatcattaaatgactggttttgttttaacccctggctagagtaaagcttggttgtatgaatgttgtcagccctaaacccccagttcctctttgtcaccaccaacctaaaggatatgaataataggataatcatatttattaatttaattttttttttttgagacggagtctcactctgtcgccaggctggagtgcagttgcacgatctcatctcactgcaacctccaccgcccgcgttcaagcgattctcctgcctcagcagcctcccgccaccatgctcagctaatttttgtatttttagtagagacggggtttcaccatgttggccaggatggtctcgatctcttgacctcatgatccacccgcctcggcctcccagagtgctgagattacaggcgtgagccaccgctcctagcctataatcatatttgtaataattgtactttatttgtgtagcactttacaatggcgaagagttttcagaaataaccatatttaatcctcacacagctatagagtaggtggcatatgacctggattttctatcaatttcagtttcagattttttgtcctgtcatccctttgagtgtccttccagtttttgatttgggaaataatgctaccataccggtggatggggcaacttttcccttctttccatttggacttgagcagactgagactcaagacttgatttgatttatactcactatggtagaagataaggaaccaagtccagaacacacattttacaaactccgagttctctgttctcaaaggaacatccattactcttagcatgatttataaaactgctttatcggcataattaaactggaatccatatgacattctttattccctagctgacaaaattagcacaggagatttactcaaatttgttattaaggctgttataaatgttcttcctttactattcagcttataaaagaaaaaagaaaaataatctgctcttttaactttgattaggatccattgactttccccatttgtaaaatagaaatgtaacttccaaatcaaaatttatggcattttaatggactgttctaaatattataatattttttcttgttcaaataacttgatttaaagcttctaattgaagaacataatagatatttctgaattgcatctctccaagcttatttcagaaggaaactcaaaaagaattgttccttagactttgactggtttacagttttaaaagagctgccaaattgtagtttactgatctaaataagaggaacattaaggttacacctgcagctagaagaaaagtgctggatatgtacaattttatgtagctggatctgcagaagatgatttttgcacacagagtaaaggcatctaaaaacgtgtctgctcttattcagacatttccaatatttcttttttaagcccacaagtctgattacctctgtatgtctcttgggagctgcaattttgctggaaagagattcagaacagtcagagcactcacataaaatagatagtttttaaagtctgtaccctctacggtagtaataaaatgacctaaaaatattctgaaagtctctcttatgacatagtggatgaatcattagcttatttatgaattggtgatattctgtgggaatgtttcaaaatttgctattccacaaagcgttcatcgcttgcataactccaggaaagtcattacaccccctcataaatagaagcttatataacggagacaaatgttgcttatattgatatatttacatacagatttctttaccaagcattaattttggtaagaaagtgattgtttttatattttactttcttggtctgtaaagaggctatcactttaaggccaggcatggtggcacgcacctgtagtcccagcgcttccagaggctgaggcagaaggatcccttgagcccaggaatttgagtccagcctgggcaatatagcaagacgttgtcttagaaaaaaaaaaaaagaagctatcactgaagagcagtgcttctcaaactggtgaagggccaggtttttgttggtggtgggtttttttttttgtttttttgagacagagtcttgctctgttgccaggctggagtgcagtggtgcgattttagctcactgcaaactctgcctcccgggttcaagcgattttcctgcctcagcctcccgagtagctgggattacaggtgtgcaccaccacacccagctaatttttgcatttttagtagagacggggtttcaccatgttggctaggatggtctcgatctcttgacctcatgatctgccagcctccgcctcccaaactgctgggattacaggcgtgaaccactgcacccagccgcggtggtggtttttaacatactacacatcacagatttttaggtggtgctaatgaaactgacaagtatgcattcacaccacatgtaactcaacagtcaagttcaacaacacttgacctcgtctgtaccctgctccatgagatgaattcattgatcatgaatttggatgtcatggcaatgtcaaattgctatagaagttacttaacacactgtccatatctatgcttgtgaaagaccatattttgagtagcactgttctagagcacttaatttttgaaagtataaatgtaaactcaaatcaagtgactcaggtcgggggaggataattaaccaaacaggaacacctgaaaatgttatttatgcggtttaatgttttgccagttgagtcaagttcaggcagaggagggatctattttctttcccacttggtagctctccttagcaattgttttagaagacaaagcatagaaatcattgtgttacaggaaggaaccagagattaagcggcagagccactgctgcctagtttaatgtctctcgcaccccctataattaaatataatgtatataatgtgataagtttaaaatacaggtttgcttttatctagaatataaactgtgatatatgcactctttatggggtgcattcagtgggggaactaattgattatactgtgactttcctattgtcactttatgagtttaggtttggaggcaatgttttgcagcaacaaaattgttcattgactttgaggctggatttaaattctgattctgtcaccagttctctgtggtcaaaaaggaagccactaataattttaaacctcagttatgtgatgtattaaatagttatgatgagacttatcttgtgttgtgaggattagaatgacatatgtaaggtaacagaatgtctgatgtagtaactgctcaaggaattataattgctattagtgatatgcattattattattagttattattatcatataccagtgtctctccttatttaataatctattgggttcctgaattgagataccaagaattcagatagtgagagacacctaggtttaggtcttcacatttgacactcaaggagccactaaatttttctgaagtattttacttcttaaccaaggtgataaagatcacctgatcacaatttatcctaacttttggaaagcatacacgtactttaatttgacatgcaaattaaaataatacattttgtactgtgttgtttgccctcccccaattctaaaataatatatcattcaggataaaaaagactacactttgggaggccgaggcaggtggatcacctgaggtcaggagttcgagaccagcctgggcaacacggtgaaaccccatctctactaaaataaaaatttaaaaaagccagaagtggtggcgtctgcctgtagtaccagatactcgggaagctgaggcaggagaattgcttgaacctgggaggcacgggttgcagtgagccaagatcgcaccactgcacttcagcctgggcaacagagtgagactctgtctcaaaaaagagcataaatatctaataaatgatggtggtactagtctgtggtagtggaggtatcacagaatggctgtagagatgaggagggctaaaactgtgaaaagccttatatggtatgttgaaggttttttatactaaggtttttgatttggaagatgtatcaatcagggtctgcctggtcagaaaacataaaccctctagttatttcaaacaaagggaatttaatgcgggaaattggttactcaagaatggaagtgctgagaagccacacacacagcatgaagtttctgttatacctagggctggagggacaatgacaagaggtggtatcaccagagccccagatgtcatgggcatcaaggcggagttggaacctttggccagctgggaccaatgagggaggggctccgagggagctggagccaggaaggagacacagttagccagacctattgccggaggtagaatgaaaaaggaagtacgcccggcttctcctttccgcctgccctctaggcttctgccagtgactcctattggccaaacttacttggaagccaattggtaagggagcaggaaaatgtactgtaataaacagcagagcagagaaaaggcagagaaagtatcaaaaaccaacaagcaaatgattgaagtacaggagatcccatggacagtaaggcaaccaaccctctatgcagatatttcgggaacaagaaacataaaaaaactaaaaagctttcataggagtttgaggtgacatagataagataccagaaggacatcctgggttcaaaggaaactgatcttaaaggagaggaggtagcaattaaaacaaattatctgcagagaagtccaaacactaaggataagcttccatgcatttgatgaaagtacttgcgacgtttacaggtgtttatgctcatgactctcaagactaaatacagacataccttggagattttgcaggttcagttccagaacacttcagtaaagcaaatatcacaataaagtaagtcacacaagtgttttggttttctagtacatataagttatgtttactctataatgtagtctagtaagtgtgcaacagcattatgtcttaaaaaacaatgtacataccttaatttaaaatactttattgttaaaaaagctaacgatcacctgagccttcagccagtaatgatccttttgctggtggagggtcttgcctcgatgttgatggctgcacagcatggtggttgctgaaggttggggtggctgtggcaatttcttaaaataagacaacaatgaagactgccactcagttgactcttccttttgtgaaagatttctctgtagaatgtgatactatctcatgaaaccacttactttgctcatccataagtagcaactccctatccattaaagtttgatcatgaaattgcagcaattcagccatatcttcacgccccacttgtgatttcaattttcttcctgtttccactacatctgcagttacatcctccactgaagtcttgaacccctgacagtcatccatgagggttggaatcaacgtcttccaaactcctggtaatgttgatattttgacgacctcctatcaatcacaaatgttcttaatggcatcaagaatcacttccagagattttttttttttttttttttgagacacagtcttgctatgttgtccaggctggagtgcagtggcgtgatctaggctcactgcaacctctgccttcctgggttcaagtgattcttctgcctcagcttcccgagtagctgggactacaggcgtgtgccactacgcccggctaatttttgtatttttagtagagacggggtttcaccattttggccaggctggtctcaaactcctgacctcatgatccacctgcctcggcctcccaaagtgctgggattacagccgtgagccaccacacctgacttccagagattttccatttactttgcccagatccatcagaggaatcactgtctatgtcaagctatagccttacaaaatatttctcaactaataagagttgaaagtcacaattttttcttaatccttgggctacagaatggatgttgtgtaagcgggcatgaaaacgtgaatctctttgtacatctccatccaagcttttgggtgacaaggtgcattgtcagtgagcagttatattttgaaaggaaacctattttgaacactaggtcttacagtgagcttgaaatattcagtaaaccatgccgtaaacagatacgctgtcatccaagctttgtttttccatttatacagcacaggcaaagtagatttcacataattccttttttttttttccttccaagacggagtcttgctctgtcacccaggctggagtgcagtggtacgatcttggctcactgcaacctccacctcccgggttcaagcaattctcctgcctcagcctcctgagtagctgggattacaggcgtctgccaccacacctggttaatttttgtatttttagtggagacggggtttcaccatgttggccaggctggtctccaactcctgacctcgtgatctgcccgcctcagcctcccaaagtgctgggattacaggcatgagccactgtgcccggcctgatttcacataattcttaagggccctgtgatttcagaatggtagatgagcattggcttcaacttagtcaccagctgcattaggccctactaagagatacagcctgtccattgaagctttgaaggcagtcattgatttctcctctagagctatgaaagtcctagatagtatcacctttaaatagaaggctgtttcatctatgttgaaaatctgttgttcgttgtagccaccttcatccatgaccttagcttcatctggaaaacttggctgcagcttctgcatcaatgcttgctgcttcatcttgcaccttaatgttatggatatggcttgtttccttaagcttcttgaagcaacctctactagcttccaacttttcttctgcagcttcctcatctcttttagccttcatagaattgaagggagttaaggttttgctctggattaggctttggcttaaagaaatgttgtggctagtttgatcttctattcagagcactcaaactttctccatatcaggaataaggctgttttactttcttatcatttgtgtgctcgcagggtagtacttttaatttccttcattaacttttcctttgcattcacaacttgactgtttggcatgagaggcctagctttcagtctgtctcatctttcaacatgctttcctcactaagctcaatcattaatagcttctgatgtaaagtgacagaggtatggctctttcttcccttgaacacttagaggccattgtagggttattaattaccctgattttaatattgttgtgtctcagaacaggaaggccagaggagagggaaagagatgggggaacagctggtcggtggagcagtcagaacacgtatgacgttgatcaattaagtttgccatcttatgtgggtgtggttagttgcaccccaaaacaatttcagtagtaacatcaacgattactgatcacgattcaccataatagatataaaaataatgacaaatttgaaatattgagggaattttcaaaacgagacacagacccaaagtgagcacatgctgctggaaaaatgtccatagacatgctcaacacaggattgccacaaaccttcagtttgtaaacaatgcaattttcacaaagtgcaatacagcaaagtgcaatttaatgagatgagcctgtaatgagcctctttaaagcaggaactgtcttcctcatctttgtcaccagtgcctggtgcatggtagcctctgaaaaaataattgttcattgaatgaagcacagtagagcaagggagagtgattttgctcgggaggaaaacaaataccactcaagaagatggaaagatacagatgagggttttctaaggcggattattaaactggcaagatggaactctggagagatggagttctttccagaaagtagaagataaagcctcaaagtaattaaaatagggaatatcagttaagttgtagattttattggcaatttgttatcttagcaaaaccaagtgaactgctattctggaattaattttgccctaaaaggaataattaattgataaggagaaataagacccgtaaaaagtgtcactatggattcagaatttatatgacaaagaaaggaaacactgaacacaatttgatgtgctgatggcctcgttcgttcattggtttcctgcttcagtaaacatttaagagcgtgccatgtattttcaaactttagggcaacaggctaaaaatatcaaggagaaaaacgtttactgagggtatagaagtttttatgatcttacttttattgaacattaaaacatggatgttcattctagaaattttagaaggtgaagtgcaaaaacaaaatgaaaatcacctcacatctcagtacccagaaatagccactatttacattttaaaagattgcttccggtcttctttcctatgcatttttatatagttgtttgagataatagaatgtttaaagtgttgtatcctactgtaatcataagtcttctcttattcttagttcctcagagatgttatttttcgctagttgcagtttattggggtaccacttttgtaaaaaaatatttcccaatttttgaaaattgtgacaaagaaaagtcaaattcgtgttgaatttatggaaggaaatctttaagaatctggaggcttattactaacaagcttctgagaagaaagccaagtaaagtgttataataccttctgtccaacaagctacttatgtataagtgatgttacagaataaagtcagtgtggtcaaaaacagacagtcagttatcagaaagttgataagtaacatttatcctatgaaaaatatagctatgaatttaaatcaatagttttctaccacaaatatcttaatggataaaattttctttaccaaatatgtatggtgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcagttattaacagaaaaggaagattgcttcctgcctcttgggtgaggaagactcatgtataccatagatatggtcagtttacatttacagttttctgtgaggcattgatttttttcccccataaatatggagtacttagaatgttcaaaacctttctctgggtaatagaatgcacaaaagtataaggcatgatccctgttcattgcccaagctggcgtgactctggtcatgcagcggacttcatgatgtgatagaattccttgcctatgagagtgaaggagatggtaccaggtctacttgtggccggtggtggaacacttacattattctaagtcctttctgtctgtagaacccaaatgacaaccatattattttatcttctcttattgctagtggtatcgtttattaatgccaacgtatacccattttgcttttcaaggttactttagatgtcttaggttggaatgactgaaggcttatacattcaaatttatatatgacacacacacacacacacacacacacacacacacatatcttattgttgcctgctatctttctacctgttgtataagaaatcctttgaaaaaagcctatgtcagcttcacaaaagatgttactgtgttttgggggaaataaaattgggaagtaataaaacagttaataaatgttacaagaccgtgtacaccaacttaaataagattaaggtcaaacgtatggtaccttatataggtaggaagagcagtattaattagaataattagggagagttgtttggagagtggaaaaaaacattgttctaggaagaaattttgtaatactcaggtaaagtaaaatgtagggccaagatattccagatagtgtagcagcataaacaaaggtatgaaagactggcttgtttgcgagtcagtgaagacattgttctctgagaatctactccagatttttttttttttttttttttttttttttgctttttgagacagggtctcactttgtcgcccaggctggggtgcagtggtgcgaacatggctcactggtgccacaacctcctgggctcaagtgattctcctgcctcagccccccaggcagctgggactacaggcacacaccgccatacctggctaatttttgtatttttggtagagacagggttttgccatgttatccaggctgttctcaactcttgagctcaagccatctgcccatctcggcttcctaaagtgctgggattacaagaatgagccaccgcgcctggccactccagatttttaaaagggaaatctgattcagtgcccctggggtgaactaagtgccttaaattatagagtgagaaatttacattgcatttgattggcaatgggaaaaacattgttaaatcttcagaaaagagaaataatgaagtccgtcttctgtgttttggaataggaatttggtgggtgagtttaaggacagttagagaggggagagattatttcgttttgttttgaggtaattgacatgatgagggtcttaggatagcaatgggggaaggaaaagggaacgtgactccagaggtttttcttaacaaggtagaattgccagaaggtaatcacagattggacaggttttaaagaaaaagggagttatatgtcttcaaaatttgaaggcgtggtgacacagagaatggtgataccattgaggaaaagaggaaattgcaaactgagcggagcaacagggaatagatatgaatttgattgaattacatacttatgggtttatttacaatttctcttcttagaaaaatttatttttggtggctcatataaatgtatgtgctgccataccataagcatatatttctcattaatcctttcaaaaaccctgtaaaagatatttgtatctccattgtgcagatgaggctcagagaaaataggtaattttctcacattgcaaagcagggatttacgtgtacttttaactcctaaaccagcgatttagcccctcagctatactttcttcctgagaggggacagtggcattttgaagaggaaatactctaaagccatttgaaaaggggaaccgaagaaagagtttggtccacagcatgataaaaatattacttgcacttttattatactttataacaagaagtacaggggcagagaaaggttcctaacttttactgagcaagtatatatccaagatacatctcctctttggagcttttgagatacactatctctcttagttttgcaacagccctaggaataggtactattactgttccctttaaaaatgaacaaaaaaaaaatgaagcttaggaaagttaaggttactagaccaagcttattgggagaccatagtgatgaagaggaagggctttagggtcaaatggatttgaattttacttcttaggcctttggtttccttatttataaaatgggattgaaataatgatatcacagttgaaggtaattatatgagaatttatgttatttattgcaaacatagggtaagcacctaataaatgataacctgagaatttatgttatttattgcaaacatagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttcgaattgggagcaattgggagcccttaagctgaatgagtagacttgaagtcccacttagaatgagcctttatatttttgttctgtggcttgctcagggaagggatacacacttggggagaaaaagacttggattctagttgatgtttttctcctagctgactagggaattcagaacaagttactaagagctttctagtccttagttctctcatttggaaaatgaaaattttaaattagagattctatttctaaggcaccatgtatttcattttcttaataaaaagtatatatattcccctaaagaatactcataagaaaaaggtagagttaaaatttcccaaattatttaattcctggttgcccagtaaccattaaatttctcagcagtcaggcaagaaccacattcccaccttgagacaagatttaggcctttccaaacttaccctcgggctctgttccaagtttatttgtaagtcagttgcatacaatttggaatgaaatgtgttataaatggtggttaggtccctaagtcacagaatcttagttaaccctcagagtgcctgatatactgcaccatgtaaatagaaagcagctgtatgtttctatgggagcaaaaaacttttgtaggaaaaatggtagaaactcgtactgcaggtgttgattattcagcaaacttctctagataaggaggactgggaacttcatcattattggtctagttacattcctggtcactccctcatcccattgactggtcagtttccctccctgtggtccttgtgcaagggtttctgcctcaccccataccctctgctccttgcccggtatcatggttcttctgagggtactactgcccattcacccttgtgctaattaggattacactgggtaaggaaagacatttgttctgtagcggagaagcggggaaggccatcagaggctttgagtgtcagaaagatttggtcttgaatgcaggctctgggatgcaaccgtagggaagttaccaaacatttgtgagcctcattttatctttaacaaagctgataatacagaactcagggccttgtaaggactcgatggtatcaggtacacacgacatttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttggattgaatcttcaaattggtaaagctttatatcaagcaactcccaaatgcagcatagttttgaggtgataaagaagagtcttttcaaggctgggcacaatagttcacgcctgtaatctcagcactttgggaggccaaggcaggcagatcacttgaggtcgggagttcgagaccagcctggccagcatggtgaaacctcatctctactaaaaatatgaaaattagctgggcgtggtggtgggcacctgtaataccagctacttgggaggctgaggcacaagcatcacttgaacccaggaggcagaggttgcagtgagccgagatcatgccactgcattccagcctgggcgagagaatgagactccgtctaaaaaaaataaaaataaaataaaaagagtattttcccggagtaccggtaatattggttccagattcaaatgtattgtccagatacacagagggtaaacaggaacgcttcaggcatcctttattaaaagcacctcagtctatgtcagagggccaggcagtccattatctaatgaaaatctcctaccattgatttattttatcataactgcagctgctaagtaattttgtttaaggaatgatttacatattagtgtcttcagcaggatctcatcattagcatctagtctccagaaaagttaacacataacagtgaaaagaaaacattctctatcacatgcttctgcatgcatgggcaatttgagtcataccacctgttcccctcttctgttatgctagagtatacaaaaagcagagatacgcatagtttactatgatcctagatgcttaaatatcttgaattgtgttctatcttggactcattattcatgcataaagactcaacagattctcttcttgcacctctcaaacagcaacatcaacaaaacccaaacaatgtatctttcctaatgaggtgaaagcatgcataccagcctaagacagaaatgttgcaaaaatgttttttgcaagaaggtcagtttgcttttcccatggtaactaaggttaatttctactgtggttcattttggcatccattttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactgtcaaaacatatgattagttgaagttaccaaaactatttttttaaataacatttatcttaagagctataaataaagaggaaattttgcactagagatgaagttatgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctcacgtcatttctccaccgcaaggaggattgcgggggtggacgatgctccctatttagtcttctgcattttgttgcttacagttcaattaacatgtcagttagagatgacttttggttgcagttaataaaatatctgaccaattgtatcttaaacacagaggagttgatattttttgtagaacaagaagtctggaggcaggtagttgagagctatggaagagttccgtgatgtcatcagagacctgggccatggtttattctgctgtaccatttttaacgagtgactttggtcctgatggttccaagacgactgctgcttctcaggcaggaagaaagagaaaggacgttcagcctcagagtctctttgtctttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccaccttcctcttatgtatctgatcaggttcctcatcctccaccatcccccatgtgacgtctgatcaccctggcctgtgtcttcagcaaggttcctgttaagttttttttagctagaatcccccttacccccatgctttctcttagtagttttccatccaccaaaccccaccctgctccttggctatcaattcccacttgtccatgctgtattcagagttgagcccagttctatactgaggtctctttcccactattgcaatattcctgaataaaatctgtttttaccactttaccgtccatctctggtttttctttgacactcacataaccagagttttgtatgtgtgtgttgcttgacacatcacaaatacctgggatacgtgtactgattttttacagggtgaataatctttttgttttccccaatatcttagaaacctgaatctttaacccctgggcttagtacacagttaggcatataataggtgcttaagtaagcgtcaactgatgattttaaatgcagaagtaattgtcacttaatgaaatatagtcaggagactcatggattttggcctgtcttcctacctgttcttgtactgcaacagtaagtgtattaaggcaatatttttggcagcacaatcatttagtttgaatgcattagtaaaaggtggagtccaaagaattaatcgctggaaagttttgggaaaacccagtaacaactgtttccatagagtaatttgagtgacagccaggtaatagctacttattggagggactccacagtcagagccttgacagggacctgaaaaagagtgtaactgaagggtaaatgtaaaagcttttgggagaacaagggagtggtcaggctgaggcaaagatctgaaaagaaatgcctcctggggccaagctggtaatttgaatgactgaaggtgactgggtgggaactggggcaacctgaaaagcttctgttagggtaacagagcctccgttgcagctgactgttctatgagaatgtgagtctctattgtcaggtcttcaggttcttccagagaagcaagacaacgggaaatcaccagatttttaactaatggcgtatcattcaacaatttcaaaaaccattatgtgagcccaaactgaccaacgaatcaaacacacacacacacaaaaaaagagtctgcagactaaattcaaccagttggtgacctctggtctgtggttaccagagaagtaattgaaatggagttttgggagaaagatcatatgttgaaatcttgggagataagggcagagaaataagtaagccgagacggcggtaaggccaaggtagaaaaggtagcctttaggaaaattaagttaagactttttaaaacaggaaggggcaaaagatgaggttaaagcagatgaggaaatttactgttatttattttcatcattaaaatacgctttccacaaatttttcaactgtaagagagagtgataaattcaaaataggtaatgtcaaccatattatgaagagtatgtttttgcaatccaaaaaagctaaggcacaacattaaaaaaaaaaatctgtgaatttggctttgcaaaggtataagaattaagtcacatctgatcatttttagagtcttaccttttataacaaagaggaaaatttaattaaactggctctgccctggcgaatctgggatgtgtgttcacttatgaagagagactgttaagattcgttaattaatgaggttgagaatagagttgaaggagattggggtaaatttataagtttgtgtcattctgagagttctgtaagtagctgagttacccatgttgtgactgagaaaaacaggagagagcagtgactgaaggttctgagccaaaggaggagaatagtattgtttattccagcagccagagtggcctgtgtgactgtaagtcgcctgtcaagagggagactgcaaggaaagtgcattgatttgatttggagtagttgtaactgcagcatgaagaatatgatatatagggatgataattgaggaacaatttaatggctgcataccttgctgaagttgaagttccttctggagataaaggtggcaaaaaagaaagtgcttaggtagaagagctttttaaaatgagttaacagaaaacagcagactaaatatggaattgaggagtaggaaatgaaggaaatgaatttgaagatttactttctttcaggatgcagagctggtatgtaatccctctgtttccagtgccttctcccacttccaaatttcactgctcctcatgcgccctggtgtgtggtgcagcttcgagattaagcctccagccttctgtcaggatgaagcagcaggtggctgagatgctaggctccaagtgggggaggtgtttagggctctaaagactttcaaccagtccttgtattttcagccacatttcagtcttcagaggaacctggagcctttcatttctgagacttcttggctacataaactggcatgcgtcttgttagttcctcccactccctgccccaatctccttgtctccccaacatcattaattgagcttgggatttctctggtctcctaagttggttaccagcaggtcattttctaagccaccaaaatactggagctctgatctgttctcatctcctctcctgttttgttaattttcttttgggtaaatgccattttttattcctcttctatcaacctggtagagtttcagggataaagagagacaaatgagtctgctccatctgctgtgtttaactagaagtcccaacacccaaaatccttcacacgatgtgcagggctctgcagtgggcctccccctgcctacctgtcaggccttatctgtgcccactcttcctccttcctctctgagatttcagcaatattggccttctaaggattcttaaagccccaccttcttctctgcttcagagcttttttttttttttttttttttttttaacatgtgctgacctattacgctgctgtgttcttacctggcacgctcccatcatccttcaagtctttgcttcaatgtcaccttctccaagaagcctctcggacctatgtttccctatgtatacagtctcatcacttcctgtgtgtttccttcaccattttaccacagtacatatgaatatttgtttgttagtttgtttgagacggagttttgctcttgttgcccaggctggagtgcaacggcacaatctcggctcactgcagcctccacctcccaggttcaagcgattctcctgcctcagcctcccaggtagtagctgggattacaggtgcctgccgccgcatccagctaattttttgtatttttagtagagacggggtttcgccatgttggcccaggtggtctcgaacttctgacctcaggtgatctgcctgccttggcctcccaaaggctgggattacaggcgcgagccaccgcacctggcctacatatgaatatttgattattatccatctccttcgctacactgcaaagtcaataaaggcagagatttattttggttaccagtgtattccatgtacttggcatggttcttggcttatagtacatgcacaataaatattgaaaggatagatgaaaggattatggatagatgaatgtcttttaagcagttataaaacagttctgcctaaagagtcttttttaatcagtagtattacttcaaatacatatttaaatacacatatgttataaatatataaaatatgtatttaaatatgtcatttgtactattttaaatgtatttaaaataatatatgttatatattaaaataatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctccacctcctgggttcaagcaattatcctgcttcagcctcctgagtagctaggattacaggtgtgcaccaccatgcctggctaatttttttgtgtttttaatagagacggggtttcaccatgttggccaggctgctctcgaactcctgacctcgtgatccgcccgcctcgacctccataagtgctgggattacaggtgtgagccaccacacctggccctctccttcatttcttagaagagttttacaaagtcattggtgataaataagtaataccatttcacatctggaaacataacttgatagtaattataaattcacagactgtactttctgtacttatctaagtatgaatgcataattcctgtttatctgtgtgtaggtttatttttcccccatttaagtaaagctctatgttgatgatgaggtttttacgagttgagattttaagaggcctcaaatatatctaaaaaattatagaccaagtatgatgtgttagtgttcctcttctctcagctaattctttaaagatatgttccagaattcctggtctgttcttgaagatctcccaataattctagacttctgaagcctggatattttggcttaatttgctttcaagacagactggatttaaattactcaatttgtctgaagtctcattaagatccaaggttcttgtctgttctagtgagtttgagctggcaagaataatacttgtcatctgaaaagtccattagaatcctttggaggagtgagactggaaaattggagacatattattatattttaaaatatgccacctttctataataggagtatgtggggagactgccttgttttggcttcttgggaaaatttggaaaattagtaaaataggcaggcagtagtagttcaatgcgtattgtatgccaaacactgaatttagaacaatactcccccaaaagcatatgtgctctaaattttatttttcacttaccacctgggagatttggattaaatttcttctgggaaatagagttggtatgaagaaacaaagaccactataccaatttatctgttggaataatcatttagccgtacagctctttccactcataaagttaatgaggtcattattgttctttctagctaatagataggcatattgaaaccttaggcctttccaaaaagtctccataagccattggaaagatagactaaaacactccttgttttaaattctagacctcagttcagtcagagatagtaggatttttgcagtattattaaaaagacagaaaccagctataaaattgaaatgaagggacttaatgttttttttctgtaatatctttggaatgcttccatggctttaaaatgctgaggtgtttctcactatttttcaaaagcatgtaacatgtagatatgtgacgcaaacttgaccagttgttcctcttttctggtgaattttgacacctgctactattacacagagtaaaagtgaaagtcataaaacagaaatacttaccaaagtcaagaaaaatgcatagactaaacaaaggggcaagagaagcctattacttgtttcatgtttcaaaataaaagatgaatggcctatcacttcagtagttggaaattcaacttgagaaggtaggtggtttgatgtttgcccttgttccttacgtttctagatttctctatttataggctagaaccagccctggataaaataatacaagttatgaagagaaatgtgcagttcagcatttttacccttctgaagtgcgctttctcccagctgccatggaaacatggcgtaactggtttcttggatagtctcactcctcttgagttccggctgtgagagctagtgagctcattacaacttggatcagagtcctggaaagtcagctcccagggaaagtggaggacagtctctcatggggcacgggaatggggggctttagctttattaaactgcatacatactttcactacacagtcatcccaagctttagcccaggacagtgtcacattgttcacagctgtattgcatcttgaggtttctgtgtgcatcctacacactttcctaaggcagagacttatctcttccagctgtaagccggagggagtggtgctgcagactcctagcaacacatgcggactcaaacaacacaggcagttaactctcttgagtagtagacttgtagggcaccagaactccgttgcagttcactgacagttaccagatatacatttgtatggcttccgtagcattgtgatggaagctaaacgtttgccctgctactttcttttttttttttttttatttttttattttttttttattatactttaagttttagggtacatgtgcacattgtgcaggttagttacatatgtatacatgtgccatgctggtgcgctgcacccactaactcgtcatctagcattaggtatatcacccagtgctatcccccccactccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccacaatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcattgccaagtcagtcctaagccaaaagaacaaagctggaggcattccctgctactttcttctggtatgcctgaatcactgtttgagaatggattggactttggtgcgtggaaaactggtagcagaaggcttattcactgcagtgggttgggggtaggctgaaaagatgtcagggaggattaactagaggcagaatgtgtcatagttagaagtatttagaagggaagaaagtttgaactctgatactgttccacactaatattcatgccctgaaagaatcagatcattcttgcctctcccacttggatctctagctactggaatttgccaattcttgatatgaacgctaagatttggatggagcttgtgacctcatttagaccatttgttctaaatgctgaatagaaccaggaaaataggaaaagagggtagaattggggtcataagagaggaatcgtcgttctttgaaagaagaaagatgataggaaactaggcacatgagttacgaggcagtggagaaggaggattagaaagggaaaaaaagaagagaaactttatgccaatatcttctacaagatgtttggctggcacaaaactaacactcaatacttttgcataagtaaaggaatgagagaaaatttgggattggatgcttatcccctggaaactgctacaggctggtgttaatgggaaagggatctgtatttgaccaaaagtgcatttccacgtctctacatttctttttataaagagtcaaagggactcaatgatgagtgtgtgtgtaagggaactccacactagcaagtacaggaaaaatttgatggtactggtgaaggatgttgcaccaatctggaggggaggacaggaattggtttctcatggattgatgccgcaagacaattcataccatgagttggctgagaccacttaaaaaagtaagcagtgatgactgggcaaaagagacaaaggaagaaccacatcttttaggggagagagagagaaggacaattaaagggactcaactagatcaagttctgctcactaaaggacagcgtccaggcaaatgttaattatcttcaagaagcaatctgtatatatagcatttcaagatactccgagatgcttttaatttattgaatactttttattggtatttatcataaacaagagactcacaaatatatcccagaggggaggttttggtgtagttgactatagtagttattaaataatctattaataaaagcccacaaaatggaagatagaaagatagaaaaacaaaagacaacacaggatggtgttggtatacagaatttatacttgaagtttaacaacacggaacaagaaactttattaaaatattcatttaaagaacttccatatgaatcaccagaggctcttagtaaaatattgattcggattcacagatctgggtggggcctgagattctgcatttctcataagctccaagcagatactgatgctattcttcctcaaatcacactttgactaacaaggactcacacaggttctctgtaattggtgttggtagtcattcatggttagatgtagttgaggactgccctcttaactacctctcggctgccaggttataaagaaagcaagtctcagtacaagttctgtcacttaggagcatttattagccaatgggtacaaaacaatcttacagcctgtgccagagacacagtgaagtcacagttctgtcttttggggtgcttggtgtgagaggctcacagtctacacaggccacagtcctctattagagtggttctcaaagtgtggtccctggaccagcagcatcagcatcacctggaaacttgctagaaattcagattcccaggcccttcccatacctactgaattagaaaatctggaggtggggcctaggaaatctgcatctttaaactatccactccaggtgattctgatgtttgctcaagtctgaaaaccattgttctagcagcaggattccctcaaccatctaactgaattctggcaactaagaatccggtgaaccacagctggacattttggaattcagcctagggcaccatttctaaagatggagaacctactggattcttcttaaactcaatttaaaggcagggagtgtttctaaatgtttttcaacaatcttcatattttgcaaaccactaatatcactacacaggcccgtctaactattaattaggaaaattaatgaaacccctggtgtaataagagctaaatataactgaatcacttacagtggccgcctgtggcatgaggctttttgattaattgctagccaaccacccttggagttcactcctgattaagacaactgaccacctctacagtgtagcttaagctaacacacacatacatcagagtgtactgttcatgtgagggtttttaaagactcttaaaatttaccttatcagggcataatttaaacactataacatgtttccattttaagtgttcaggttagattttggcaaatgtatacactcgtgtaaccaccatgccaatcaagatataacatttcgatcacctagaaaacacccttgtgttcctttgaggtcagttacctactcccaccacaccccaggctaccatctggcatagtagctaagttttgcctgttctagaagttgatataagtgaaatcaaacagtatgtactgttttgtgcctggcttcttttacccagcttagtgtttttcagatcagttcacattgttgcattatcagtagttagttcctttttattgcactttgcacagtagtatcccactgaatgactttaccacaacttgtttatccattaccttactggttggtttccggtttttgactattatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgttttctttcccctagttgaaattcaggcttttatgtttggtctctgcgatggccataaagctgaaaatgttgacccaagtgacttggatatggattgaattattgccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctaggtggcgtgagtcagggcttgatagaccggtgactgcagaaaccacagtaacatatattgttgttattctgtgctgaacattagaatgattgtaccttagaatatagagccaaatgtttattttattcctaattatatttttaaatacatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagattactttctagaaaaaaataatgcctgtccatctctttcctcttgggaacaggactacatgaatgcccttcaggctataccactttagtcttcacagaacttagccttcctggttgtcaaagggcaaaaggaattattttttcttttccccacgttaacagaattttcacctccgaaagcttggcgtatacacactatatgttttctaggctatttttgtggtggttgtagttattggcaaatcactgggcgtcgggggtgggttgtctgttatttctgatggaataacaaatgctctttgttttccctcttttcagctgacctgaataatgtcagattctcagcttataggactgccatgaaactccgaagactgcagaaggccctttgctgtaagtattggccagtatttgaagatcttgatactatgtctttgcttagaataaaaagtaggttgggtacatttttacttagagaggggagaaacagctgtcacaattcctgttgcaatgtataattcattctttaatgtatccttggcctagagtttgcctagaatgttttgttttatttttagaatcattcctgtcaccattcctcagctactgatgttgaattaagatattgagaatttttattttccaactactggcattggcatcggcatccataattacctttgtgaaacttgcacaatccttgttctacctttgtttttttttctttttacaaaatgtacttagtattagaagactatgactatctgatctaaaccaaacttcatagacatgtgtggtttattagcttgaatgctaacgtgcagatgaatgaagtggtagaggaaaaatgacagaattgctttcctccttttttatcatacatctgtggaaaaatcctgaagtgttacacagctctatcatgtcatcaaatagtttatgtataactctactattgtctgagggtctgtgtgcattgatgatatgcccatgaaacaggcacagtttctttttctttttttctgtttttttttttttttttttttttttgagatggagtcttgctctgttgcccaggctggagtgcagtggagtggcgcaatatgggctcactgcaacctccacctcccaggttcaagtgattctcctgcgtcagcctcccaggtagctgggattacaggcatgccccaccatgcccggctaatttttgttttttgtttgtttgtttgtttgttttgtttttttttgagacagagtctcgctctgtcaccctggctggagtgcagtggcgcgttctaggctcactgcagactccacctcccgggttcacgccattctcctggctcagcctccggagtagctgggactacaggcacccaccaccacgcctggctaattttgtttttgtaattttagtagaggcggggtttcaccgtgttagccaggatggtctcgatctcctgaccttgtgatccgccctcctcggcctcccaaagtgctgggattacaggcatgagccaccacgcccggcctaatttttgtattttttaatagagacggggtttcaccatgttggtcaggctggtctcgaactcctgacctcaggtgattcacccgcctcagcctcccaaagtgctgggattacaggcgtgagccaatgcgcccggcccaacaggcacagtttctgctctgatggaacttacagtctaacaagggataaccaggatgttcatgaaatttgtagacataagcaaatatatgtataatgtattaagaatgtctacagttggttaaaaaaataaagtgatcttgtctctatttccaagaccatttcaatgtcatatatttagttgtgcaacagtgggacaatggggtactatgtgaacagctaactgtgtggaatgagattcaaagaatgtttgtttgaagaggtgatgtctaagctaggtaactctagaagagtaagcagctctctctctaggaagagcgttctagtcagaaagaagagcatgtgctgaagggcccagagaaagcatgacacattcaggaactgaaaatatgtcagtatggctaaagcacagaattccaggggaaagatctattgtgaaataataggctggagagagaagcaggaagcagattgtgcaaggtttttaaaacccaagttaaggaatttagaggtcaggggatttggcctgggggtgacataatcagattgtcgcttagaaagatgattcttgctgtggaacagagtatggattggtgcgatgtgggagtgacaggagaaaaacctgttgcagtaatctaaaccagcaatgtggtggcttgaattagcagagtagtaagggagataagtggagagaatttagaaatatttaggaagtggatttgacaggcctcagtgattcatttgatgtggtgcagggatgtccaatcttttggcttctccgggccacagtggaagaagaattgtcttggaccccacataaaatacactaacgctaacggtagctgatgagctaaaaaaaaaaaaaaaaaaaaaaaaatcgcaaaaaaaaaaaaaaatgttttaggaaagtttacgaattcatttgggcctcattcaaagccatcctgggccacaggttggacaagcttgatgtggtgggtgaaagggagtcaaggaagacacttaggtgcttggcttggaatatcaggtgaatgtgggacttgtctggtaaggttagacacggagctgtggtgctcaggagaaatatacaaacaacgtttagggatcatgagcctgtaggtgctgcttgtaacgggggagaggattggatagctccaggaaagtgtagcgtgagaagggaagttatttaggacacaggataagcaacctacagaagggactgcaaaggaatggccaggaggaaagaaggaaaattccaagaggttatgatgccacatgctccatgggaagaaagaaagaacccgttaccagggtcagatgttgctgggatgtcagcataaagttgcggaaaatgcccattggacttagcaacaggaaggtccctagtaactttggtgagattttagaggcacagtggaagtggtgtggtgagttcaaaagtgaaccaaaagtggagaattagagaaggtatgaatgattcttggagaaatttacttatgaaggggagaagagtggggtggtagctagttggagggggctgaggagttaatggaaatgtatgtacagtcacgtgttgcttaacaatggggatatgttctaagaaatgtgttgttaggcaactttgttgttatgtcaatataggagagtactacacaaacttagatggtatagcctagtacacacctaggctgtatgggatagcctattgctcctaggctatacacctgtacagcacgtgactgttctgaatactgtaggcagttggaacacaatagtaagtattgtgtatcgaaacgtatttaaacatagaaagatacagtaaaaatatataatagtgtaatctcatgggctcgctgtcatataggcagtccattgttgactgaaatgtcattatgtggcacaatatgtgtatataagtgtgtgtgtgtgtgtgtgtgtgtatacattgatccttgaacaacatgggtttgaactgcttgggtcaacttacgtggatttttttcaatcaaatgcaggccaaacatatagtattcgtgggaatgtatttatatgagtatgagaagacagggtgagattacaattattggcccaagaggagatgataaataatgggtgttctcagagaatacgggcaggtaatccagagcccaagggagggaagagatacctctcttccactgtaatgggtggggtagagggaaggatctgggcaggtccaggtaactaagaaaccaggtagcagcaaggtgaaggatgtcttactataaaggcttccattttttgtatggagtggagagtccctgcaacgcagttaacagcaggagatgatgaagttgggcttatctttgtggagaataagagagagggcggagttgaaaaccagctgtgtgaacccagaggcggctgagtgtttcacggtagctccaatctgcaggggtgtggtatttccccaggcacgcttagcacttgggagccagatgcttctgtcctggggtagggagggaacagctgggcaagagaagtgaggatttgggcaaaagattgattaaaatgatactgacaagtccctgttgggtaggagaagctgtgaacgcatatggaaactggtaattaggaggtagagggatgaaaatgctaactcttcagggaggtaggggaagaagtagtaaaggaactgaaggtcaagaagttgtggtcagagagaatcatagatgaacattattttgaaggtggaacagtttcaggtgattagatctaggatatagccatttgagtaggtggcagaggtagagtggatgtgaatttccatggaggtgaaatagcaagttaaggaactgagaggctagaatgatgcatgagtcccccatgccaatgttgaaatcatgcagaattggagcgagaactgggcaaaagagaaggaccgtgaaccctggctgccaggtcttcagaaataaaggggttcaaccagaggatctgcagaggctagcaataagatagtcaaggagtcacttggcatatggttcttacacagagatagagaagaaatgccttagaagtggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaaaaaaaaaaaaagaaacccagaaatagaccagatggaaaaaccttataatgactgttcctttctataatgtccattttcaccctggatttaggcattattcgattttcctgctcaaaaaaaattccattcacatatgtgttttattgtctgtcatttcaacttataatttccaataaactttgggaaaatgggggaatttcataatatacaaaattttgtccatttgaggtgataaccttgtaataaaggtaagctccgaatgtagaataatttctttaaattttcacttttaaatcaatttgaaattctctgcatttcctttctgagcatggcttttctaatatgtgaaaaagattcaagtatgccaaaattaaggtgtatgtatctaaattaagtattgaattctcattaatgctaggagggtgccatatatagtaaaactatagaatgaagagttcaccccatccttttattgaacatatgtgtggtcacattacttactttcaatatatgatttaagaattttctcctaattttatatttgcttagatttagcttccaggcttttgtcatttctaagcctgcaaagccatgataaagagctattgtctgcggtacaggcaaataaaacttgccctggctagctttccctaccaaaggccacttctaccaactctaactttaaggaaaattaatgatgttatctcagtgatttcctggtgccagtgaagagtttgaattacagatgccttggaaatatgcacttccacctctattaagcacttgatcttatttttttttcacttccctatcaatgtttccgtattgcagaaagccaaataacccaattgtatccactatagagaattcactatttaagtggagagcatcaccgttggcctataatgtccccagtttgtaatcagttaagtgttgcatgactccttactgcctctcaacacattggaaatgaaaatgaaacttggtagaaaagcaggaacaaagataaaatcttggtaagaaggatttataaactgtttcatatagctgatactccattgaaagttatgaagaaggtaatttaagcattttctttctccctttgtagttctgatgacattctacaggtgtgaggcttctaaaattaaaaagccaacttgtaagagcagaaataaaaacgcacttaacaaagcaagtgtatttagtttattaataatgtgtggtgggttggagagagcccaaaccatagggctaaatatactgcagttgataagtgtgacaaatattctgcaaacagtaagaaatagagaacattttgcctctattcagcaactaaagcacacattatagagatttggtacaggctggagttgtgtgaatagtcacagtttctggactcgccctcaccatgacaaaccaggtgaaaaatgcaccgccttctctgtaaatgcacctcaccttttgatggtgcgctaagggtgacattagataggcttcagttgctaaagaagactctcaggacccacaataacatggcttacaaatccgcgctctattgccagaaaaggctacattacaagagcattactgtcaggatatggatccacagccacaggctgcctccacagcaagggggtctcgagaggccagtgtaattattttgccactgtcctacaaaaatctactttttctatataccatgtattatttttcacataggttagaggccatgtctctgttagttctgagtttaagacgtcttgaggacatggccaaactaattttctcagtttatatggtttgacagatattagtgcccaagagaggtctcataacatgacccatctatctcccaggggaaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttctcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttccctttaaaaaaaaaaaaaagtatcggctgggctcggtggctcacgcctgtaatcccagcacttcgggaggccgaggcaggcagatcacgaggtcaggagttcgaggccatcctggctaacacggtgaaaccccatctctactaaaaatacaaaaaattagccaggcgtgatggcgagcgactgtagtcccagctactcgggagtctgaggcaggagaatggcgtgaacctgggaggcggagcttgcagcgagccgagatcgcgccactgtcctccagcctgggtgacagagcaagactcggtctcaaaaaaaaaaaaaaaaaaaaaagaaaaaagaaataaaaaagtatctttggtggtttccttccccttgcaacaatctcacctttttccttttatcattaattttaagccaaacctcttccccagctacacacacacaccacacaatgcagacagtccccaacttgtgaagtttcaacttaacaattttttgatttcacagtgatgcaaagtgatatgcattcaatagaaactctacttctagatttgaattttgatcttttccaaggctagtaatatgcggtatgatactctctccccttgctgggcagcagcactgaacctcagctcccagtcagccacaagatcatgaggctaaacaactgacactttactgtgtaaggtgttgctagacagttttgcccaactgtaggccgatgtaagtgttgggagcacattgaaggtaggctaggctaagctgtgagtttcagttagttaggtgtattaaatgcatttgtgacttaagatattttcaacctatgatggggttgtgtgatagcttcaattaggcaaggcacaaggaaggagtaatccattccattgatccttgtggaatgcttgtgcttaagtaccaactaatagccatagtatcttattttggaatattaccagcctttgaaactcttaattgtagccccagttcagggactactaggtctggcatcaaaaaagaaacctgtagtgacatagggaatacctgtaagtgccccacttgaattatctttttaattgtaactggtctcacaggtgtagcccatttctcaaaaatgatagttgcttcagctttttggttgggactccacctgcaggccagagagggtgaagcccagtggaaagaaattctgaacttaacattagcttttggatttttttttagcagccttgccatcagtttgcaattgcctcctaatccattttgttagctccttaggttcaagttctctcacttccagattccactagaaagttacaccatcagtaaccaatttcaaagcctgtgttacttttcaaccaagcgtagcttgttgagcaacttcaaaggttctttttcatcccttttatcagaatcttctttttttctttctaaataatgcctcagtcatacttttagctaagaatgagttggaggtgttctaaacaatcttgcttctgacactcactgccctgacagtggaagttaaacagggttcaattgctaaagaggactcacaggaaccaaatgacagtgcttacgaatctagagttccttgcagaaaaaggatgcaatatacccacaacattaaaacaagaataagtgtcacagccacagcctgcctcacagcatagggtccagagaggacaggtgcaagctataattgccctctgtctgcaagagccacaccacgatgcattttctctcttggaacaagagctactgatgtgagcacagaacaccttggaaaccagggagcacaaattggagtttcagccagggtttcttatatcccgtgggtaacctaggcatactgttcctatgtaaccagcctcaaactcagtggcttccgttggtctgactgtgcccgggtaaaaatggtcaatgttactgttagcaataaacaatggtgataacctgcaacccatggctacacttcaacacagtaagtcactttgaaaagcaagtgctttgaccagggctctgcactgtgtagatattttagcaagtcatctcgtgccaactccagcctctctggaattaacccttactgcacagacaactacatcaaagtgcattgactttcttgaagtgcaaagatttgcttgggaggtccctcagccataagtgtaagttgcctgtagagtggcatgcctgggcaagaaaaatcagcaaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctagatatcctgccataacacccagagtgagtctccatatctctggtctcagttgtctcaactgcaaaatgattttaaagcaaccttctggctctaagagtctatcactctgtaaaagacaaaaaaaatctgtcttacataggaaggaatagcaagagttagctactgtggcatacatagaaaggaaaagaatgagcttttgaagctagaaggttgagaagatgattaggcacaaccagagcctcaggaaccattagtgggatccctgtgttgaagtcctgcctgctcgccgccccccaaccgccactgtctgcttttcctgcacagcaaagaggatcctggagagtcagccatttcttttatcctgtccccaccctctctcacccccacagccctcatgcatagggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacacacatatatatatatatatatataatatatttaatggaaattcctagcttaaggaaacaatggtttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcatggattgtgtatacctaaatggaaattttttcaaaatagctccatgaaagttgaattctgtttgacatgtttgtttagggaaatgtgctcttcagtcttctgtgatggattgttcttgtgtttaaccacatccagttttagcagagcacactgcacagtatttctctcctaactgtgtcatcttctgctcctgtaatttcagagcaattgctttgctcccctctggagctatttctactcaacatttgctgttctatgtgttacccattcacctgtacagagataagagcaggccccataaaatgaaatgcatgcagtttttctctgttcatttccatcacacggctaaataagactcttaatacaaaagtgattcgaaaaattttcactagttacttcttaaatgcctggatcagaggcaaaatatttatgatgactaaagcagagtaacaaaaaagaaaataattgaaaaacttcaaaccacccatagcttccttcagtatataaggaaacatgttgggaatattggtgtttggaagaaatccattcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaactggatagattatgcaattactttagtttgcctatagaaaattttagtggagagtatttttttcacctaatattagggtagcagagagatgctgaggtgactgatatttcaaggagaaaagcgcttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttctcaaactgagaacatttttcgttttcttttgttttttaataagattttatgaagtttcagtttggcgcctccattcatcactctctcttagagaacaattgtttgttttggattgcacacaagggagatatccccagttctgatttttttttttcttgagcttaatgaagacaattgaagaagggagcagaaggaattggtcttaattttgcctaaattcttcttagatctcaaaattattacatgcctcatttcaccaatcaagaacatactcccatttggaaatctgggaaggttttctgaaaagagttgcaaaacaactgttttgccttttacctttgttgtagacttctactaccttttgaactaaaatttatacctttttttctttcttattttgataaggtattgctttttaaaatttcaggaccacctgactattacattcatcatagtcatctaccaagtccttgaacatgtcggatttcaattgtgaactacgttcacattagttttgataagagtttgtattcaggtttcccctcaaatatattttggcactgttttctttgcagatgacatgtgaatgcattctgaatgtataacttccttctacctgactgaaaagtatttggtgacaattttaactccttgaagacctgagttgctgtataaagtggatttgttaaattttgatctaccttttcttaagagggagaaagataagaaaattttccagtgataggaatttgtttagtccattagtgcccaggatttctttttgactgagggatttaataaattttagtagctggaagttgagcatattgttcaccgaaaataaccgccattgggacctatcctttgtgattttgaagtgctaataggcgaattattctgaaatattttctcctttttctttttaccaatatctaagggccagtagctttccgtaataaaataagaagccaaaaaactattgaaagacactttttaactttaattttaggtttcggggtattatgtgaaggtctgttacataggtaaactcacgtcacgggggtttgttgtacagattatttcatcactcaggtattaacccatttatgcctagtgttccattattggaacactaagcttgtgggaattattcctatcctactgctcaaggtcatcgccaaggtctgattttcacaaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttcttaatttatgtagaacttttgcagttcaaataagggtttttaggaattgaaacttggtaaacattcagtggtcaagttggttgaatttccattgcattgtaggtcatcagtcaaagagataatgaatttggaaaagttcaaaacaatcttaataaaacagtggtcaatagagttcacacatcattgagcactttactcctttatttttccttttcaaggctttattcttaactagaagtgtttaccctctaggaaagggtcagtaattgttttctgctttgattcttcataataggggacgaacagggaggatccgtgtcctgtcttttaaaactggcatcatttccctgtgtaaagcacatttggaagacaagtacagatgtaagtcgtgtatattaatgctgtattcttttattaatgttggctaattaccctagttctagatgggaaatgacagactgttcttatttgacagcagattcctcatgtaagatgtagaactgcttttagagtgtcataaaatttggtttgtgccattccttgtcaaacattaaattgcaggcatttaagtagagaatgaggattagcttttccagtccaggtattattttacattacattgactgtgtctgaataaaacacatgttcctaggggataaagtctgattttctaacctctttctgtaagtcggaaaaataagtgtgaagatttaatctctgcacttgtctagtctttgggttcttatttaaagaataccatgtgacattcatgttcaagaaacattgtttattttataatcatcttactgcaagttgtactgacacatccaattccgtgacgtgactaacattttattatttgagagacagatagcttgctgtttcttaaaggatagatacgtaccaccctacagaatttccttttgattacgcattgggttcttctgcttaaaaactgtaaaaccaaattaaaagccaatgctagaggagtgatggttcagatgaccaagtgaccatccattcatattgtgaaaggctgcagttggttttccccttgaaatgcttataagcaatcttttcagtaggaatattaaacaaattcagcctagcttgtcttttctctcttcccctgaggcctagccacacatgtgaggagatgtgctaagcttcaggacaggcaggagataaaagccactctgtctcctactgatcatttctccttcaggagtaagccacaaaatacacaaaccattttggccctcacttttatgtagtttccacttgagttttctcatcctcagaacgagagaaaaataactgaacagcttttgttaaccattttaaaatgtatttcggatgagatgggatacctgtgtgcttttctcctttaaatattgtagttacttagtataggttaggttctaatctaccgtatatatggtatagtgacagcacattgtaaatataatattaaattgaataattgaggaagctttgagttggtgtttcgaataactactaagagggaacatgtttttaggttggtgaaacaaaaatattaaatgcaaaatgagatgtttgaaagtaactcataactttgaaaataaacacctaggtatgtatatcggagagcagataaaaagctgtgcgtacaatctcaatttttagtgccatcttaggtatcctgttaaaacatttaatttcctagagtttaaagtgtgcttatgggtacagaaagctttcttggatttactttttttgaggggcaacttctaggtgaatataaggtatgattaaaattttatatctgagaacaaaacataacattgcaagcattcagtatgttcattcattctgttacatatattgggcacctactatccaccgggtactgccattctactgtagatacttctggcacacaactgaccaagatatggttccttccctcaaggggatataagtctcctgccaaaaacgatagacacatattgaatcaatgccagcataacatgatgtgagctattaattagaaatacgcagccaggcgcagtagctcacacctgtaatcccagcacttagggaggccgaggtaggaggatcacttgaggtcaggagttcaagaccagcctggccatcatggtgaaacacgtctccagtaaaaatacaaaaattagctgggtgtgatggcatgtgcctgtaatcgcagctactcaggcggctgaggcaggagaatggcttgaacccgggaggcagaggttgcggtgagcagagatcgcaccactgcactgcagcctgggcgacagagcaagactccgtctcaaaaaacaacaacaacaacaacaaactatgcacagtatcctgtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacagctgtccttttttttaaaactgtcctttgtagctttgacattcccctattattccaaagtctagaggtgtatactctctgctaatgtccatcactgactgaacacactcttgtccgttctctttcctatcctgtcccattgctttttctctgtcgtagtcagtgccccagaaacaccctcttcttcccaaatgcctgagcactccactggtagacattcatcttgttctaatttttttttctctttccttttttttttttttttcttttttgagttgcagtctcgctctgtcacccaggctggagtgcagtggtgagatctctgctcactgcaacctccacctcccgggttcaagtgattctgctacctcagcctcccgagtagctgggattacaggcgcccaccgccaccccaagctaatttttgtatttttagtagagacagggtttcaccaggttggccaggctggtctcaaactcctgacctcaggtgatccacctgcctcgaactcccaaagtgctcggattacaggcgtaagccaccgtgcctggcctctaatttttattaggtagatagtgctacaatgaacatccttatcgtttagcttttgtctttgaagctttctttataggatcaattctcaggcgtgtgattgccagacaaaataatataaacattttttgtggcctttcttcaaaagttgttctaattgtaacgctatcagtattgaaggagtaagatgctttcggtatcacattattcacagtgttcttatgtttttgtttttggttttttcaagtgctaagagctgtttttcttatgtagggtttctcaatccattctaattctattaacaatggctgagatttacaaaatggaactagctgtagaactaactgggttatatctgaagtctttgaccacagactaggatgaaactatagaaggtttcctgggcagatcactgtgaatatttaggtgtttaaagcagtttgagtatttatttaatagttagttggatagatttaccggatgcacacataataagttcatttatgtaaagtgggatatactgtttgaattattttgccaaaattatggcaaattagttgtaaatgtaaaatgcatgtggagaaataaatatcttttcctcctcatacccaaaccttccaaaatgcagatagatgatcaatccaatcaatcatcaaaatgtagacacaagtaacttccatacaatgaatattaatggccacaggcaatctaggttcattttgattttttaaaatccaattataaaacaacttgccataaacgcgagttatttcctaatcttttggttgtgtgttttttttgttttgttttgttttgagatggagtctccctctgtcgcccaggctggagtgcaatggcgcgatctcggctcactgcaacctccgcctccctggttcaagcaattgtcatgcctcagcctcccgagtagctgggattacagggtgcctgccaccatgcctggctaattttttgtggagacagggtttcaccatgttggccaggctgagctcaaactcctgatctcaagcaatccacctgcctcggcctcccaaagtgctgggattacaggtcctaatcatttttcccctttagtcaagtctcagttactctttgagttctagtgaaacacacacacgtgttcatatatagggatatataaacatatgtgtgtgcattgtgacttgggttaaaggtaaggctcagtgatggtccctgctgcaaagtaaactaggctgtattcagggccagctggattctttgttttctcgcccgagtactgactcatcaggaagccaccaccatcctcactgcagcctctggccctcttggatttggttgtcaggataagcggtggccatacagaagctctgctttccctgggctgccccccttatcaggagaccaacctattccatttctgcctgctacatccttttgctggataacctcctactcccctaagcccatgtctctggtttggttacatttctgtctctgtaataacaactctgtattctcagtctcaaagctttgaattcagtccatccttgcatatttgttgaatgcctcctggttggccagccagtctccaagctctttgaaatgtgaaatgtgttttgttttgttttcagaaggggtctaacttcgtcacccaggctggagtgcagtggcacgatcacagctcattgcagcctcgacctctgggctcaagtgatcctcccacctcagcctcctgagtagctgggactacaggcatggaccgccacgcctggcatttttttggtgtatgtgtgtgtgtgtgcgtgtgtgtgtgtgtgtgtgtgtgtgtgtgtgtgtgtgtgtacagggtctctcgccatgttgcctaggctggtctcgagctcttgggctcaagctgtccacccacctcagcctcccaaaatgttgggagtacaggcgtgagccacggcatccagccttgaaatgttttctatgagactggggggaaatcagtcaagatatgaatggtggtaacaggtggcttttgattttctctgtactatttttattttctgagttttcttctttgaacatttataattagaaaaaaaattagtaaagtgctgcctctttttttagggaaagaaacatgttttgtttgattgctttccattgccattcttacattgtttccaggccttctcatcattgcactggcttcctagcaagcctccacttcacactccagtccttttcattggtcttattgccctcatactagttttagagaaaagcatttcccatatgatgccgtccttgaaaatgtcagtatctttctgttgtctagtgaacaaatcctaattcctctatttaactctcagacctttcctactctggtttcataaccacccatagtttgctttcactatcatgaaacagcttctccttaccatttgtacctattatgcttataaataatattgttaccattgctactaacaaaactttgttcacatgaattctctcatttaatcctcaccaagtctttgaggggaacagaatagtcaggctttggagattttgcttttattattgtttaagtggatgaataatttatttgcgcccttaaagtccctcagctggtggaagggtttgattcctagtccagtatgcccaccgccacatttactacctcattcccaaatatgtagtttctgatacttctgctctccagcttcccaaggccaaacaacagctacttttcctgagtcctggatagaataagaaaaggtataacaagacaggggacccttgagggggaagaggaattagtttgaagtgctggcaaatgtagtatttctaatcagatgctagtaaattccatatgtatggcgaggctttcattacttagatttggggagcctctcagcgttttagcaatttgcaatcaggttgaatggatccattgtaaatacttaggaatacttaggaatccacgtcctggccctggcatgcttttcctcggccaggtgcactggcggtcaccttgcctttcattgtgccacgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacatacatgcacacacacccatctttattgaaaatactctaatcccaacatagctgtttagtctatcttcagataaaaccaagtatcacttttaggtgggaaaactatacagtcatgtgctgaagaatgacgttttggtcaatgacaggccatatatactatggtggtcccataagatcaacgtaagaagagattataatggaactgaaaaattcgcattactttgtgacactgtagccattgtaacatcatagcacgaagaattatttcacaaacctgcactgccagtcatttaacaggtaaaaaagtatgttttaaaatatttttaattattatggacacataatagtactcatttatgggttacatgtgatattttgatacaagcatacaatgtgtagggtaacacaatcagagtaattggggtgtccatcatctcaaacattcatcatttctctggtaggaacattcccatttcactcttttagttattttgaaatatacaataaattattgttgccatgcatggtagcacgcacctgtaggaccagcgtttcaggaggctgaggtgggaggatcacttgcgcccaggaattcaaggctgtaatgcacaacaattgcacctgtgaatagtcactacactccaacatggacagcatagtgagaccctatctgtaaaaagatttaaaaatatattgattactatagtggccttattgtgctaccaaacactagatcatatttcttcttactgtatttttgtacccattaaccatcccttttttatcccccgatcttcactacatttcccagactctggtagtcatgattttactctatctccatgagttcaatttttttttttttttttttttttagctcccacacatgagtgagaacatgggatacttgtctttctgtgtgtggctgatctcaacataacgtcttccggttccgtacatgttgctgcaaataatgggatttcattttttatggctgaataatattccattatgtgtttatagtacattttctttatgcattcatccactgatgggcgcttaggttgattctatatcttggctattgtgaacaatgctgcagtcaacatgggagtgcagatatctttttgtggtttcgattttgtagtatcttcttcagtaaacattttaaggactttattgtttagataacgtcaagtataccaactttatattcaatatgcttcacctatgagagctggagtgtcaaaatctgtttattttacatctgttttctgcctcctgttgtacttagtattccaaatgagtaagttgcttttccatctatcttctgaatttctctatttgtatgacaaaaatgaataccatctatgcacagttgttgtaataatgtagaatgatatgaaaatgagaataaattacagtctcaactgttgagaacaagtatttctctgtgttagaaacattcccaattctactcttttagttattttgaaatatacaatgtattattgttgccatgcatggtggcatgcccctgtagtcccagctactcaggagactgaggtgggaggatcagtaacacataaatgagaaagcattccagaatatctggagaagtgactggcagagtggttaagtgcataggctttgaaaccgaactgtgcctgagtccaaatctgagctctgctatttgctggctgtgtgactgtggacacatttcttaaccttcctggcccctgaactcctggaggtgattgtgaggattaaatgaaccaatagaagcaaagcacttaagagctgtagtggatacatagaaggtgcccagtgaatgttagctatgattatctaaagtgtgttgtggcatgaaaatatcctgccaatgttaacagttgcttttatctataacaaaacatcatctgtggattgcattttagagattctggagattctgtttctctgcaaatgttaaaatgccatatcaggagacttttggctggttagacagcattccccgggtcaactgattacttttttttttttttttttttttttttttttttttttttttttttttttgagacagagtctcgctctgttgccaggctggagtccagtggtgccatctcggcacactgcaacctccacctcccaggttcaagtgattctcctgcctcagcctcccaagtagctgggactacaggcacgtgccaccacgcccagctaatttttgtatttttaatagagaaggtttcaccatgttggccaggatggtctcaatctcttgaccttgtgatccgcccacctcagcctcccaaagtgctgggattacaggcatgagccatcacacctggccgattccattttattaatagattttccatcctgaaagtaactcctaaaaaccctccttcacttaggtttcctttggctttttgtgtattaatcagactgtgggccctttggttccatagacattccttttacaccccttttggacggatgaatactcactagtaactaagtaattagtaagagttactacaatttggtatttataaagaggtggcctttcccagaattgaaggtagaccctaatagtccaatcagccttccatagagatagctggctgccatgaaaagctgagagatatcaccgacctcttactgggcctgctcatgaacagttagttaaaattcctgcaattttcagaaaagacccttatcagagtattatcagtattgtcttaagtttaatattggtttccagttgttatttttaaaaattttaagctaccgtgggttaagctttatgatgatctgtttaagtggtttgtttgattaacttctctattggagtaatggatgttttcttcaccagaattttgaagataggtttgtgttgtagttgaaacctgttttgtttatacacttactgctaaggaaaagcacatgtcattttgttttccatcttcatccttctaaagtagcacttcattgttatgaccaaatctttctttcttccttccttcctctcaccctgtcttttccttccttccttcctgccctccctcccgcctctcttcctttcctctcctctcctttcctttctttctttcttttctcttttctttcgttctctctctctccctccctccctctctctgtccccttctccttccctccttccttcctttcttccttccatttctatcacccctaaaattccatcatgctgtatcatctcactaagtcccaatctctggaaaccacagctctgttttctgttcctgtaattttgccttttcctgaactggattttaaaggattgtaggaggcagtagtggaagagctaactttatatcttgttcttttacataatgcgccctgatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggtagttatgggaagccttttacttcttcttgtctcacaaagacaactcttgacctctcaatccttaaacaaaaagttctgcttctgcgcatgtggggactcttaaactcattttcatgcctggagattcacatttagggatctaggaaaagcacatctaggcagagtcgatgaggagatgctttaagaaccgtgacaaggacaggaaggaaatcaattttgcgttaggtttgtatttttagagaaaacgaatcctggggaacttttcacactcattactattgacattaataccattgtcctgtccctttcacagttactaaaatcactcttgcccaccctcctgccttgcccacaacctattcccatgaaggggtgacttgggagaaataacggtttccaaccaacgttttattttggaaacatttcaagcacaaagagtagttgaaaggatagtctaaagaacactcatctgtgtcatacatctgttcaatccatggttgcttttcgctctacttacctcctccaccctctcagctctgtttatgtatgtgtctgtctgtgtacatacacacacaaacacattttcccctatgccatttaaaagtaaaggagcatcacaacataaacccctaaacacttcaccatacaccattttcttaaaggatgacattctctaacataactgcaatgctatcgttacacacaaatttaacagcaatccagcaataccctctgatatgcagtccacactgaactttccccagtgccccagaattgttccttatagccactgttttcttccagcatctagtcaaggtttttgtctgtcatgtctctgtaccttcatttagttttgaacagtctcccagcattttgttttcctttcatgacattgacttttttggtagggggacagagtctcgctctgtcacccaggctggagtgcagtggcgcaatctcggctcactgcaacctctgcttcccgagttcatgtgactctccacctcagcctcaggagtagctgggattacaggcatgcaccaccacacccggctgatttttgtatttttagtagagacagggtttcaccacgttggccaggctggtcttgaactcctgacctcaggtgatccacctgcctcggcctcccaaagtactggaattacaggtatcagccaccacgccgggctgacgttgacatttttgaagagttcagaccagttctcttgaagaatgtcccatactctgggcttttctgatggtttccttgtgattagattaatgttaacattttttggccaaaagacgataagatgatgctctgtacctaccactgtatcacaatctggaggaacaaaataacattttgttcctattggtatcactaagaatgttaaggtggtgtctacaagatactttccttgtaaaatatccttttccctttgtaatgagaaagtaattttttgatattttgacatattataatatccattccttaaccttttaccctatggttttagcatttatggatgatccttgtctaattcagttataatattggtggttgcataatggtggctttctaattctaccatactttctgcatgtattagaccattttcttatgtaaagaagagcttctacctctcccccgtctattcatgaatatcactgtggacatccaaggtggttctgagtgtacaaagaatgatatctctctttactgaactgccattggatactatttttgtcttggaattgtttaaaatggcagtgtatggaattgaaagtcctttctccagagagccacataaacagatgtctaataaatacatttccatattaaccaatccttttatgggaacaacacattgacataattaaaacacgtaacatgaaaactgtgctgaattgagaagctcatagagttttgtttcttttttttcctttttgccacttcaatatatatggacccgcacctgtcagtccaggtagctcatacatgccgtagcatctaatggtacgagggacatgtaatgctgaaaagaagggggaaaggagttgatcagatgagatataagtatgcatttatcagtgttgtggggtattcacttgcaccttccattggctctcgcagccatgttatcggcatataattcagttgaagatttatattcacctggaaattgtcctaagtgggccttgcttacttagctatcagactctagtactttcaaacaaattaaagattcaaaagattttggggatcgccttgctttttcccataggaaatcacttttgtcctgtctttttaagactattttaagcatatatttcagtattaaaatcgtagataatcttaagctgtttccttaacctctttgggccttttcttatctgtaacataaagttaaaacaggttatctcaaaagttacttatccctaagtgtctttgattctatgctaaatgttataaaggccgaaagggaaatggattattgtacttatttcaaagcttggccatgatcagcaaagtcttacctgatcttccgggtaacaactcttgtatcagagctataagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacatgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcaccccctccccgccctccccctcccccccccccccccccccccgcccagttgtgacaaccaaaaatgtctcccgtaaaagataccaggatgaaatcactttttgtcagtcccaaactaactagagccagggcagcatgaaaggaggagggttcatggttacatgcctgagataaagactgtctcaaggactttctaaaatcgccccacaagaaattcctctgttaggactgcagcagtgcacgtaatatgctctcaaaagaacatctgcccagtaatggcatccccactaataaactgacaccagttctggcgttgagcatctgaaacgaactatgtttccaagcagcttatgtaaacttctgtttttaccaataaaagtttccctctacagtctcctcttcagatgcatcttgggttgtaatcctcatttctaattccaaaataaatttaacatatttggcgatgtttttctctgatgttttttggtcgacactccaaacattgttatatttcctctggggtacggcatcatttccggttgagaaccaccgacctagagaaaagctatctgcctgtgcagttcctttcaagggccccaagtgtgaattttgtgtatacctatattttaagccagatcattctgtacataccttctaagtccagatgaagtctgttagccttttatgtgtgataccatcacatagaaaccaacacaaggacatttactgtaatcgataaaggaaattttggacagtttgagaaagtaacttattttgtcttctgctctttataaaatctttacaagtgtatgtttttgctcttcaggatgactaggcagctttttaaaattctgacttcatacagattttataatcttccttttatttcttgcgatcatattgcagttgaattcccacccactgttcaattcagcagattttaacagagactccagaagtatagttcctgtctttaattaatctgcaatttaggaaagaaattaaggaggtatcgttctgtattgtttccaggatggtggtttcttgttatctgagaattactgggcacagtctcttgcccaatgtttacttctctatatagagttgacccttgaaaaacatagatttgaactgtgtgggtccacttataagtggatcgttttcaaccaaatgcgtatcgaaaatgcagtactcaagagatgtgaaacctgcggatatgcgttcagctgggcctactgtgggacttgcgtatgcgtggattttgctgtatctcaacagcaaaatccccgtgggagtggggctgcggcgggccaggaagcaacccctagcatatactgagggatgactgtactaattattgtagtttattaagtgttcacatggttttcacaaacctcacaattgaaatgccaattgccttctcctaaaaaatacaatgtacgtgttcatggtagctgggatgcagggcttgctgagaaatacttaattgcatttcttctgtagccatgaattgattttattaccttgagagaaaaatgagtattcaggtggacctcctggcaggcggttggcccttcagtgtccaaggatttatagaaagcacaacatcaaagaaatccaaaagttcttcggaaccccagcaactctcctacctccaaacttgccatgtaatgcccttttaaacttattatattgataggtaaatcggtttgctagaaattccagatattgagaattctttgtctgtgtaccttgttatatttgtataaaggtgatatttgtatgaagccaccctccagtgtgctgtaacagagcaatagtaatgacaactgattccttcccctagcttttctgttatggatagttgctggcaggtgaggaccaacagaaaaagaggagaaacccaacataattccaaactgtgaccatcataatggaaggagctgtgatagctttgctttctgtgtgtgcatgacatagaaggggaaaatggagttattgccaaaacaacagcaaaagcaaaacaaagccaacaaacaaaacaaaacccagggctaaatgacctttccaagagattttgcttgcatggcttgaaactggtgtttagagatgaggacaaggtcacccttgatactgagaggggattatatctgagacttatatgtatctcaacaaataatggtacttacaaagattatctcagtccagtgaatgccatcatacttatcttttgaccttaataacttcctgctattccaatctatccctatatatttttttctggaatgatcgaaatgtaattttagctgggtttaattctagttctgttaggtctttacagaagcttgcctggcttttaattctttccttcttcattgccagacaaaaggagagggaatataccactaggatacagagtagtttgtcataaaaatgaaagattgaaacagaatgagaacgtgaatccccgtaccttgtcttcagtctgtcagttggcgtaggtgagcagttttaaaagagccaacatgatggatcttgcatcttaggggctagaaatttgagaatgttcaacctttaagcatagaagaatctatagttttttgaaagagtagaacattctacagcctcccttggtaattcacactaatgctttaacaactttcagcatcaggaaattcttccatatgagctacagcctaaattcttcatgctgcttaagtctgtttcttcttgttctgtcctcagtggagagatcgaacagctggtcacaggcccctatgcgagagccattcacataattgaaaactgttattaaatcgccccttcagaagtcactcttgcttgttctctctctctctctctctctctctctctctctctctctctctctctctctctctctctctctctctctctgagaatctgggaagattccagagctgattaacatgttgctttactgatgaccttctcagcttttaatatgttaacgtgctctaagaattttaagaggcagatataatgtgcactgtttctttcattaatttgaccttctcgtgaagcattttgctggacgattgatctgctggacatactgggaaacactgactcagagattttagttgagtaggaaccgtgtgtgagcctacggtacagaacaaaagaaagtaatccagttacactgtctggagaaatagaggtacattctccgcaatcatatttgaagaatagttttctaaatgacaatggcaaactaagccgtgtcatatgaagaagaagtaaaaagaataggaatgaagaggcatggacagataagacagctctggtaaaatatttaaagggctgttcaaagaccaagaacttctgggttgctggtcagatggataataataatgacaataacaatagcaaacatgattcttgctatgtgtcagacacggttccaattgcctttcatttgctgactcacgtaatcataaaataactctatgaggtaggcactattaatatttccagtttgtagcagagaaaaagtaagacacagagagataaagttattttcctaaggtcacacagccagtgagtggtgaactccagtggtttaactctggaacttctatatgctgtgctgatggatttcagctcaatgtgatgcagcacttttgacaggggtatctggacacaggtgttcaggatcaccttctaaggatgtttcccagctctctcacatgggtggtgtagtggctgtaagcacacactggcatgggtaagagtttggactcgatgaatgctgagtttggactcagtgaatcctgaaagtcttacagctctgtggtgccatgccaaaaggatgaatggacttgcatgatctttttcatttttagattgcataattctttataaacttttttttccacaaagtacctctgtgatggaactctacacagagaaaagtgctcagcaacagctttttaaaatttaacttgtaagttcaggggtacctgtctaggtttcttatgaggtaaacttgtgtcatgggggtttgttgtacagattattttgtcacccaagtattaagcctaatacccattagttattttcctgatcttctccctcctcccaccctccatcctctgataagccacagtgtgtgtttttcccctctatctgcccatgtgttctcatcatttaactcccacttataagtgaaaacatgcaatacttggttttctgttcctgcattagtttgctaaggataatggcctccagctccatccatgttcctgcaaagaacatgatctcattcttttttctggctccggagtattccagggtgtatatgtaccacgttttctttattcagtcttccattggtgggcatttagattgattctaggtctttggtaaacagtagcatttgatcggaagtttgaactgataccattttgcagctaggaaatccaaagttaaacagtttattatagtgttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaaaaaaaaaaacaaaaaacatattaagcacacaagaaatcaaggtggaaaaagaaagaaatcaaggtgaatgagaaccagaagaaatagcaaaccatagaagcagacctacgataacatcatattccagaattattagacagattattttcttaattgtgtttatgcagttagaaaaataaaaaacaacattgaaaaatatctacagggaaccacaaacctgagaagttaccttaaaaatgaccaagtagtatttctagatgtcaaaagtacaataatcaaaatttaaaactgtatgggtttacagcagaccggcaagagaaatggatacccagacagtaaggcagaaggaattaataagaatgaagcacagaaggatgttttaaaaagatgtggggcagagaggggggaactagggaagtcctgttcagagaaatatagattgaagaagagtaacatttatgtaacagagttctgaaagtagaatggagagggaatggagaagaggcactatttgttgagagaatgacggagaagattccacagctgattaaagactctaaatcacaggtttaagaagtccagtgaatcctaagcagtctaaatcaaatcctagaaacagcacaagatagaaaacagatagattatctttattttttttattttatttttattatactttaagttttagggtacatgtgcacaatgtgcaggttagttacatatgtatacatgtgccatgctggtgtgctgcacccactaactcgtcatctagcattaggtatatctcctaatgctatccctcccccctccccccaccccacaacagtccccagagtgtgatgttccccttcctatgtccatgtgttctcattgttccattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcaaaggagcaacagtcatctttactattgacttctcagcagcaacagagatagacgaaagtggagtaatatttcagtattcaaaaacaaaataaaaacaagaccccaaaacctttcaatcaaaaattttatacttgggccaggcgcagtggctcacgcctgttatcccagcactttgggaggccgaggcgggtggatcattttaagtcaggagttcgagacctgcctagtcaacatggtgaaaccccatctctactaaaaatacaaaaagtagccgggtggggtggcgtgtgcccatggtcccagctacttgggaggctgaggcatgagaatcacttgaacccaggaggcggagattgcaggagccgagatcacgccactgcactccagcctgggcaatagagatagagtcagtctcaaaaaaaaaaaaaattgtatttaatgaagataactatcaggaatatggattttttttttaaaaaaaggaggtattttcagacaaacagagcttgagaaatgcaccaccaacagctaaaggaaattctaagggacatatttcaggcagaactaatcccagatggaagatttgagatgaaagaaagcaatgaagagcaaaaaagtagtcaatatataggtcaatctatctaataatataaaaaattaaaacaatcctatagggttgaaaaaaacaaggtataattaaaattcatgaatatagtaacatataaatcaaatggtggtattttgagattgttgagatcattgtcctgtctgggatgaattgtatttcttacatttagactttgaaagagagagaaatagagaggcagacagaatcaacagggcatcatgaaaacagcgctaagccaggaggtttggattctattatcagctctgctgctagctgtatggcctttgaaaagctccttttctggtctacaaaatcagtttgcttgtctgttagatgaggctttggaaccagatgaattttaaagcccctcattatgattctatgagaaacagattctctagaaaaaaaaatcagttgtccccctcctttgaaattttatcagtaaacacctgcatttcacttctggctaacttttatgtatcagttcaaaaattaaagctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactcttttccagttacgtgtgaactggttttgttactttattttctaataactaccttgtactgttgcgtgctttttattcatagtgcttttttacttttggtgtttattgttccatagtcatgctgtttacaaagaggttttacaaaaacttttagaggtttctgaagcctagatagacaacagtgagtaggtactgcttgcaaaggtcaccttctttccttcccggtttcttggcaggtaaaaatgataccatgggggtggggagtggggaagggaagccacagtgactgcattagatttctaagctaccttttctctgcttccttagctagtgggctttgtatacaagggaaatttttataaaataaagaagaagaatgccttggaggatctgaaagagcactttcaccttcaattcttttgcccttatcatattatattattttaggacccagcacttctcattcctcctgtccccctcttgaaagatggctggaatctaaaaaagatagctttccttcccacttccccatatgtgacataagaaatatgtttatttgaattggctaaggttcttatctgagaaagcaaaaggcaggagagtatgaaacaaagaatatcgcattctgataatggaggaaatgtaccaactagtatttacagattataaattcttccatctaatccaaatttcatgttctcttggggcttcagttatcatttgtaggtaatggggtgagagatttctgaagagatagagataaaagagttcattcgagtaactgtttgaagatgaatcgtatcagtcaattagaaaacattattaaagcgagacttgttttaattgaaagttcttgttcacatttcttttgtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgtttattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgagtttggttgaataattttaatgaggtgtgcggactgtttatcaggttatgccatgctatttgactaatcattatatacaagggtttctaaattttgaactaaactcactttgctctcctctccaagctaaatattcagctcataaacaattatacatttgctctaggaggaaagtatttctttgttattactattggtgtgtattaataatactgagcttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgttccaccatataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactgaagtctgtgttttctttaatagcagtaattgtatttaaagtatttattcataggattataaatactgtataaaatatattacaaagccatcctattcaggcataagagccaggtcctaacgtgtttcattttgcaagacttgtatctaatgttaacaaatcctatgatgattacaatatttgatccatttgatatggatcacagaatttgaaagtttccagagatacagaccgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatagagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactcccttttggctcattttctggtttaataaatgtctcttttagtgtatattttttaagatttctggttattgtaagttcttgtgcttatgcatgctgtgataggcgccactgatattaataagaaaaataacatggaattatccttgaggcaaagaattaaagctctgtataagattttctgtataaaatggtattaaagtattttggatttatatgcctacttttcttggtgtacttatgctccaaggtcttaggctttcattcttgtacacacttccaggatagcaactattacaagggaaaacactactaatgtattttccctgatggtaggctttttgcttattaaaaaaatatgtaattgaaagactggtctgttccaaaagatagttcttataatacaaataatccaagtattaatttatcttgatctgcagtgaagatttcaaaacagaccttagcatttttctaataatgggctatgccagggttctagaagattaacagattaactctccaaaactatagtgaagtttcacatggaaatctttggatctgcttattaaattgagtagtcatcgttttgtttcctcttgacaatttaaacgtctttataactcatttcaatttgattatgattacacttgacctagatgacattggtttcataaataagacctttctctctcagggaagaattccatttccctagttatttgctatagtgtgtcgtaattatcttactgtagtatattaagaaatatgaatttctggcacattttctaatgcaagcttagctactggtaactgcatctttttcttttttaatgtaagaagaaacaaacacattctccttagtgtttcaaccaagtccttcaacgctacttggacactgggctaaaccagggtcctctctgaattacattatcgttgacttttggatttatgcctttacctaagggctttctgtgtcagcagagaaatggaagagaccttttgtgctattccaattaaaagaaaaagtccaagcctaaactggttttcagaacagatggttttttttcctaaggttaatccaaaagatactataaaaacttcaaggataattaatagatcagatatgaaaggatgaaaaaatgttaaccctaccagaattctagcctatggagataagaaaagataggtgtttatatacaaaaagcatatagactattcctgctaatgatctcctcttattttctcacctatgttttagcacacagtatctctaagaaatatttcagatatcatgacgttctatgaaatttagtcattcttttttaaaacctcacaatataatccagggtcattctattttgtgctagaaattagtggtatagtcttgctgctgaattggaagatacatttcttctttacaaaattgcatagatcaagacatcttgatacatggagttttaagaagtcttgtactagagtagcctctttgaagctaaaataattgtaagtatctaggcagatatacagctttgatccaataagaagatagcctataaatggcgcaggtgtaaactatttaaaattttaaaccacatagggctaacacaatttcggaattataggatgtgagaaattacaaagtaggaggacaaaatgcttcctagaaactgtctcccccaaccttttctacgatgggaattttccagagaagattttggcctctcttcatggcttttaataaaagcagaagtatgagaaatcatctctcaatcctggattttaaaatacttgataatatttaagatataggagcaactaaatgtatacattatccatagaattagaataaaagcattctaggccatgtgtataacataactgtgtggtgggttttttctccattaatggatggtatctgtgactaatcacattttctgccttataggcctgcctcgtcccctcagctttcacacgatgatactcattcacgcattgaacattatgctagcaggtatgagactagttgtatgccaggcaaatattgattgaaataactaaccaaggaaagctaacctatgatattttaaacaaatcttttctttttttccccaaacttgtctgattcctactaatcaacttgccctctaacgtgcatgccgttccactgcatgttgtttttggtcaccaacaagagcattagtccagaataatcttccctaaccctggcttttaaacatttccggtagccttgctatgtttttttatactgagcacatttactaaattggcttacaaatagtttaacctccttagaaaactgctagaccagacattcatatatgaaaaaatgatactatattatatggagaatatgaaagcatcagctttccgtttgtgtatttattttacatgatatgctgtaaagaagagaataattaattttcctaatccttggacttttctgtctcaccttctttgtgtttgagatgatttttatacctaaaaactgaattactaattttaaaatattttatgcttgttaaatccgtaagagtttggttaacttttttagttgtaaaaaaacaaacaaacaaacaaacaaaaaaccccctgtataattgcctgaggtgaagaagattttaaaggtaaaaattggtggcagaatgtttagagagcttactgtgcatccatcctttgtcaatattctaactgctggacatgtttaccaatcgtgaaaagcattagctagctgtgtaagtctgtcatcagtggaaagtagtaattgtcctaaaagacaaggggtagtgtaaggtagggagtgcacttattgttagggaagcttttcttctgaaaacaaagacctgttctcagtgaaagcaagactgatctgtagggggaaaacagtgaaatataactttccttagaatttctatcataaatgtagtgctactaactagctgtggtctaccacacactgcctcaaatggttaagccaacacacacatcctttaatttgaaggattcctttctcttcttgccatgatttatcctttagttttcaggaatgttcgattaggtcttgaatagattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactttaaggacggagatagagcggtgctaagagcagcagggaacacagctatggcagggaaacaggcttcattatagagtgagggcagtgttcacaatacagagcacaaaggaacattgccatgaaccaagtaaatgctgaccggggcttgaggtagagagagcagacattgaagcaaatatgaaggaaaaaataaggatttgccaagtgaataaataacataaagagaagaaatctagtcaaagtattacgatgcctttttagtttgataaagtaaggatatctcacccatcttggagaatatagacaaagggaagaatggtaaatttatcatatgtagttggtgtggcaacacaaagtcatgctcagatgagaaaagaaccttcataaggattaggccaaaagaaatagtatcaaagtggcatatatataactagttattgaagacatgagaataaataatctcatctggtacataaacgatcaagctaataataaagaatcaagtcaaccctcagtcatttgtatatgacttacttccttcaaacaaacaaacaaaaaagcctttccccaaccataactgtgatgccttatctttcttagctatgggaaaaagtattaatggtactaatatataagatacttcaacagtaaaatgtgtggccaaagaatcagccaaatgtaaatagcttgtgcttctttggctcactgattttggtattagaagctctagcacattcagattaattcgagttgtatctacgtaacagtggctgtcattcattgactgcctaagagaacaggaagaaaagtgtagttacaactctaggttataattaaacatgggaagttctagcagtacaacttcagaatttggaatgagtgtgataaattaggtggtaaaactgcttttgttttattttaaaataagctttagcttattctgaggacataaaatccattttgactcaatgttggatggcaaaaactcatggcattttaggggcaggtttggggaagtggtttggtggattggttgacttcacttaaatgtgtgtttttaatacccaataattatttttagtcagcttttcacatctaaaccaggtaactggcttgataaacaaaaataattcaaatgagaaggactttttcctaaatttctgatatttttcaacttaagtgggtatggagaggagaatattagcgtatcatcttaatgatatctaaccagaaacaatgagctttagcctgtcattacggacagaagaaaattcttataacttggaggtaaacaggcctttccggagcttggagcaatgcattcagaaaaaagtttgtcctgtgtattagagagttcctagtttccaggaaagattgtagctgcctccccaaatagaagcctttttgcctccttttcccgcaagattagtccttaaaaccattatgtataaatttaaaaataaataaaacttgtatttaaaaaaactctgccccgaggaatgagatgttcagtcttcttttaatcagtcaccttaatgtcttttttccccttaattttcgttcttctgtctaaacaataactgaatgaaacaatcatgtatctccagtttaattgttgttgtcattctgcctcaatgacttatataagttaaaactgacttactgaagcaatactttttggttacattgccttccacttaataaaatatttcctctgttacttttagagctgcaaggtattttttcctactcagtacaacaatagcgtgggttagtgaacagattatcttgacaggcttggtggccaaagcattatacagccattattatatcttttaatattttttagctattgactaacatcaacgtagagtcccagtatttctgtaattctgcctttcatttatccgtgtaaataggccaatcaatttcatttgaaaatctgagcaagaaaacactttgaattggtaccagtagaatggtagatcacaacctcagcagtatcaaaaggtctttagaagcaggaaaaaaggtctaattaattgttaagagcaaataaatgtttctattttcaaatacactcctgagtccctaacccccaaagcaaaataagggggggaaaaaaccaaaacctttgattttattttccagagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggtgagttttctttctagctttgtcattggtatgcagagtgcatacacttgcacacatagaaaagtgccaggaatcttcacttagagtcattttatgtctaattgttttctaaaataatctgtttagctccatttgcagattctctctctcttttttttttttgttatctgaaagaagacaatggatgcaatagtatgatgaagaactcatattttaggtgtgaaggagttaatgctgatggtggtatttgacttgttgcatgtgtctccaaggctttgattttatatttcagaatagaatttaagaaaaaagtaggttatttaattttatgattatatgattttttttacatgtgtttggccatattatctacctcaaacatttaagaaagtagggttattggcttggtcatattgggaaaccaattgtttcatcttatttttcatcatcaaatgcagaaattattatttatgctcaccatcatagcaggttagtgagacaattccaattgtcagccatcacctgtaaaagacagtcatgtaaaaatagcagaaattgtagaagagaaaaaggctaaagaactctcataatgactgcagggaggacaaagatgtaaacatctggggtactgtattgtgtcaggataatgcaaatcattggactttcagttctgtattacatttattatgtcacaggtcccttggtttaaaaagtcttctcacatgatcacttctaactcacaatgtgccttcttcagacagatgccaccaagcaaggatttaaagtagatgttgctcagatttgtgggtcttaagtactttcatctctttggttgagcccaaggcaccaaaagctcttaacgtaggcaacgcagtgtgtctgagatcagtgccctcgggagtatgccacttcaggatgaaaaaacaaactgccactcttccattgcttcctgctgccactgcgagccttctagctcttaacaccttttacctatggccatagctccttatctggttggcttccctttagtctctttcccacccttgcaataaatcctccatactgactctacttgtacatcttgccagaaccaagacccatcatggcattcccctttcactggatttctgcatgtagaaaaaaatcaagcttcttagtggggcgttcaaacccttccacaatattctcttgacttgctttttctatgccatcttcttttgttctccctgtgttctggctatgctgttgtagctagtatttctgaatacatcctgctctcatctacctttggggtcaagctcaagcttgagtctcagcctaactgctaacctctaacccaccactgccgtatctgacaaaggaatcccacctatcctccatcacactgctcaaaataactttccccatggagccctgctagatccctgcagttggaagaaatctgtcttttgcctctattcccagagcactttggacctttctcagaaaattccttgacagttttcctttttatcagttattaccagtgcctctctttaatgagctagtgtgtgtctttggggcatggactgtatcttaatcatcttcatatcctccagagtacttagcatggtttgaatatttaatggctactcaggaaatgtttgctaaaaacctgaaaatacagcaagaacatcacatgagtaccatccacgagataatattgaactttttttgttgttttaatgatagctttatttttggccgtacttttgagatcatttgtcagtgaagaccatggtagagaaaacatttctactttattgagaataatcagtaatatccatttatgttaaatctgtaattattgtaggggtcaaagtcaaatcggaataaaaagttggaactgacactgtaaatagaatttgatgttaccaaggagtaaatatatttttgaagtatatgatcgtgtaatatatcttttgagctcattggtcaagagccctgcctcgtttgtggttagcatagtctttctccgtaccattgcacccgggtcaaagaatgtttgtaaagagtactgataactatcatttatttatcattttatcattttgagtgcacttttacatattttagatcatttaatcttcttacaaacgctatggagaagagactgtcgcctttctgtgaatgagacacaggttcttagaggttcacacagcttgccccagatttcccagtcagccagtggtagaactgaattgaaatccagatttttctgactctaaataggcaactctgccttcaaccagataataaagaagagtaagtctctgtgaatgtcatttacatagaattgcggcatattccccagaatgtgccttaacttgagggactatctatgaggactgagtgtcccggaataaacctgttcatctacttgtggcacagcgataaccgctttaccctggaagatatccaagaccattctccaagaatgggatggtttgttctctaaaagaacaaaaaacataacaccaggcctacttagagctccaaaatgaggactctggggttgatgcaaatctttgtgtaagttaccttgaccttcacgaaatgatcaggatgagcttccttcattgtcccttcattttgtcctatttgaccttctaccaaattccaaagaaatgtctccacagagttcccttcctgaaaacagcccgtgtgttttctttgatctgccctgtcctgtcttcttgcagttctgcgcaaggagcttcagagccctagatttgccttcgctacccttgaattcagtgttgcttaaggagcctttaatttgccatttcctgttgagaaaacccaggaattctttagatgccctctctgtgcatgtctagctggctatgtcctaagtcagcattgggctacgcaatctgacaaatacgagcatacttttagagaaaataagaaagtatatttaaaattgagattgccccaagtcctttggatgtgtacttattgatctgttaatatatatattttatgttcctttagctgtgatttatctccaaataacagcaaaagagagaggcctggagagccccattcctgactagatatttattaaattccattaattgttcttattcatgacacctccctacaaccccctagaaaaacagaggatggctgtttgagaagtgtctcagaggtatcttatctctgcctttagaattccatttctcctggttgttgcacatagtattcaataaatatttgttgaatgcattaatgaataaatgaattgaagctgaatttattttaattgtagcatacatgcatgcacttttgactaaagttcttttacaaacctaatttcgtagagaaaagcctttcaaagactttgttttctgcttgcttttcaaaattctcccctttttcaaactgccttgattagcaccaggcatggctttgtcataaatttagaatgttaagaacccgttttccaaatcacaggcactgtatgtatcccacattggtgttctctgattcttggttgatgccacagagataaggctaaagctctgagtaaaagctaaatctgactgagtttttcccatagtgcctcccataagtttggatgactaatggtgttagtgagatatctaatctttaatatttcgcttctgcatcatatttctccctcattaccacatataattcagatacatctttatttggcaaagagccactggatcttgggtttttgccccattgtgtgtccttagcattgcagactcaaggtttacttttttttcttgcgttgattaaagccttcagtctcctgacttaagcctgtagtgttcaaatacagagatgtatttgtctctgcactgtctaaataaaccaagacttgctctgaaattcaaggtatgatcctagcaatgaaaaggtagcctttctgagagacaaagacattgtcgttctactacctgcagagcaaattgattagattgttctcaagtcaacaaggtggctaaatattaacctaattcaccataaagtctaaagttaaagttgttagtagatgttatataacacgagggaactctgtagattcttaatacctactcaggacctttcatatgtcttgttgggcagtaagaccttatgaagccaaaatttgagttttctctttttcctttaaattcctccagtgattgtgcaagattattattgttacagtcaaagaagttctagatcagttactgataccactgaattaaagtagctggaaatcatgatcccgttgctttactttgtaattgacttgatgactttggacctagtctagtagctatcaatcttcatagctacgggaaatctttattcaatgttctttcattaggtctttgtgcaagtctccaatgatggtgaaaagatggccaaaatgaagggaatctgaagaggttaggaatgggcattcctatggaatataaacaaaggtgtcagggtgaggaatggcagagtttgtttgagggaaactgcagttgtattaccttttttaagaaggcaaagaatgagaggagatgaggctgaccaggtcagcaagggcaggtcgggaagggtgtggtacccactgcagagttgctgcctccgtgcctagtctagggagcaactcaagggtgtgatccaggagtcaggccatgatattgacatgaatatacgccacacaggcagctgtgcggagggtaactttgaaaagagcgatgctggaacgaggaaatcaagctggggggagtcacatgggagcccaggaaagagatgattagagccttaagtaaggtgatagaaatgaagtagacaggctgatctgagtgatatttcgggggaggatagagctgtttgattcggtagttctgtgggactagggtatgaaggaatgattcccagggctggtaactacaaaacaagatgatagtagttatttgcagctgggactgataattcaggaggagttgcagcaggtccatcctttaatgcagcagtgtttattagaggtccttcctgaagggctgagtagctggaaggtgataaatgaggtatggaagaggtcgagttgaggtcctggtgacatctccatgtgtaaatgtctgacagtctgagagatagaactctgatgcttgtagaaaggatataagcctgagatattaggactgtgagtcgccagctcacaggtggtagttgaaaccgtgagaatgaatttatatatcccgggagcatgtagcagaaggagaacactggatttggtagaactccggaagatgtgaacattaaagtgtgtatttaattacttttatttttagtagagaatacatgtatattattatacaaaatccaaagggttcaaaaagacatatagagaaaagtgaatccttctccaaccttctcccctggctgtggtgtttccagctctggaggctgccatctttcttggtttcttgtgtttccttccaaacatgctctctacatatgcaaatatttgcaaacatatttatggttgttggggttacttcacacagtgtcgtgcagtgttcactctggttttctctttttacttaaaaatctctaattttcacatgctggagaaatgtgccagaagaagaggagggcagagcttgggaatgatgggagcattttcccacaggaggcaggagagagaagggttagggaactaaagtatgggaggaggcgtgaccttgaatgagaggaaggactgcctctgaagacaaagtggtaggtaaggaatttagggtaaggaagggaggaaagaagcataatggaatgaatgttaaaatgtccagtagacatcactggaaataattcaagactgattcctacggctgttcccacatgtttttaaagttggagtggagaggaaagcgtggtatatgatacatttaacgaaactaggcattcaagttacttggtgtattagtccattttcatacggggcaatttacaaagaaaaagaggtttaatggactcacagttccgtgtggctgggaaggcctcacaatcatggcagaaggtgaaggaggaggaaaggcatgtcttacacggtggcaggcaagagagcatgtgcaggagaactgccctttttaaaaccatcagatctcatgagagttactatcacaaaaacagcatgggaaaaccccacccccatgattcagttacctcccactgggttcctcccatgatatgtgcggattatgagagctataattcaagatcagatttgggtggagatccagccaaactatatcatttggtgacatgggccccaaaacaaagggctacagagcccttcttgagacaaagggagctagtttgatcacagaaatcagaaagccaagaccttttatggcaaggatgaataagagctgaagggcatacatgccacatttaagaagctgtgtaagaatggggtcaaccatctcagctctactcaggcagggaggacaggaacatggtagaagtggaatcaccattattcacagactcagtttctaactagcagggccagtgtaactaaatttccttcagtttatccaaagttaattgaagtctgaggggactgattcatagtatgcagttcatggcagtgaatggataacccagaatgaaagtttatttctccctttatcctaattatctctctttttaactgccttgtattaaaatgttatcaaggttgccttaaagcttttttaggaggagacagcatctggtttaagtgcaaatactagatctattaaaatgaggaatatattcattttttcggcacacagcatcctgtgtcttagaatccagtgtcttaggaatcacaataaaaatcaaattgtgttctggtgagcctagaatcttggcatctaaaattggatgtttgtgaggactgcttcatactacaaaaaaattgaagcacccctctggcgattagaatattcacatcttacaagtacagctgccatctccctagaacatgctggataagagtttatgttcttacaatccaatttcccttttttttttttttttttttttagatttttcatgaagaccctcatcctcctgttggccttcatttgccaattgtccctctacagtagaattgattatggtcatgagtttctttagctactttccaggcctgaggatgtaattctgttcaattctgcagatagttactgagtgcttaatgtaattttaaaattatgagactacaaagatgaataagccttggttcttaccctcatggagctcaaaatttattttaaaaaagttaaaatagaaacaactacttatatcctactgttacaagtgctctgggggcacagaggtgaatgatttattctatcagagggagtagagaggcctttacaaagagagtttaagagttgaagactgaatgggagttttccagtctgagagatgggggaaggatgagttttccagactggtggaccagtgagtaatgtgtggcttggaatgaggagaataagagggcagtgggatggtaggtggggactactgtttaaaggactttgtgcatcatactaaggagtttgggttttatcctataagcaggtgaacagtgatggctttttgacgggggggaggattgagaaaaataactgacctggcagaaagctaaagccatgaagattggtagaagcacagtggaatagtccattaaaagatgccaggttcttaactaaggatgtcttaggcaagtgaagaaggggatggagaaattagaaggtcactgaatgaatgagaccaagggaaaatggagagggggaggcatctggtgttacggaaagttttaatttgggaactgggaaatgatcattgaaaaacaaacaaaagcaacctagtgcacccaggaaaaactcctgatttgcaaagggttagtgcatggagagaaagagctacgtatcagacatactgaattctatttgcccaaggacatttcaagtggaaatttcctatgttgattttacgtattcagttttcagaaaggattctttaaaaagtcatagcaatacaattcctgcaatataaataatagatcaatgaacatcatagggattagcatagttgatttgactaagcttcagattcagtttgagcttccctgtagccagggagataataggaaacaaagatttgtctgtctcttaatattgaattaaagaagcacgcagcatcctaaagaaacatcattgttttcctggctctacgtaataataataataacaaaaatagctgtcctttgagtgattgctatggacaggaactgttctgagtacatatgaactcctatttaatccttaaaacaaccctatgaaagagaggctgtttccagaggattacgtggcacagagtattaaggacacttcatatggccagcaagtaataggacctgtattcaaacttgggtggtggtcctgaactcttaagcagcgttacacttgaagtgattattggctagtgtccttatcaacatttttataacaaatcccaagggaaattatatgtggctgtttctcatggcctttgataattgtggaaagcttaacattaaaacaccaaagatagggtgacagttctccaaggataaaggtcactgttgcctaaaatgtattctgcagaataccactgagatactctgagaaaaaaaggattccaaggacagtaaaactttgaaagcactcatactggaaagtcatcattacgttagcatttgcactgaggagtttggaagtgaagaaacctgattagctttgtctaacctcatgttgctcccacttacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatgggaagatatttctccctctttatcttatgacagaaatgcaggtatagctttcatctcaaagtaagattaaggtataagttacaaagatgtgtagctactatatggtcctgtgtaatgctacttgaggaaggctgttcctttcctggcactgaaattttagagcttgcataatcagtatatcaacctcgtgtggcttggtgcttagcaagtttcagcttctagagcccatggctaatggagccatccaggagaatgttggagagataggtctgaagccttagaagagaagtcttgattaaggagtaatgagttgcgggaaggggtcatggttgtggcggagatggaagcctggggagaggacagagacctcctaggaagagagtttgtgtaagaagaagaccaaggacctcctgatgtacttgattgtaattgggcatgagcagcccagttagaaatggtttcctgttggtattacatatgtacatggatggcttctgcagatggctaaactcacccattttatttttttactatcttaatagttaaaatatgaccttttcttgtgtctccaaattctgagttaccttatggtgctagtctgtctgttgtaactacaagtcataagtaaatccatatgattcttttcctgtaatttcctggtaaatcaaggcgataatttcaaagataaaaatctgtatttttagctttagcagtgagcatgattcccagtctttttgccttcgagtaaggtttgtttccatggtggaagtaaacaatatcccacactctagaatgtgagctcttcaagggtaagggacagtgtcctacatatatctttatctccacagcactgggtacataaatgtgtcataaaaatgaatgggtaaatatcctttggagtttttctgttacttgatgggtttttggggttgattttcaggtatctcccttgtttttctcatttcttacattattttctttcccaaaatcccttaatatacctgtttagtttgtgatgtcattttccattagactgaaaccatccaagttgtttaggctaacccagacttaagcattttctgggcttatttttggactctttttaaaactcatcatctgaaaatatttaatgtccacacggataattctgaagacatgtgcataccatttttcttttatgtacatgggttaaaccttgatttttccatagtaggagaaagcattataagattttattgttttcactggggtaatatcttttgtgctataagaaataaaattttgaatctagaacttagttttttataagacctttattgagatataattctcgtaccataggagttacccatttacagtgtattagtcactgattattagttaataggttaaccagtattagtaatcactggttattaattacagagttgtgcaaccatcagcgcacaattttagaacatttttatcaccccccaaaagaaatcccatccccattttcaagtcactcctcgtttctcctgcaactactcttttcagccctagcagtagacaatccctgatctactttctgtctctatggatttgcttattctggactgttaatgtaaatgaaataatacaatataaagtcttttgtgactggcttctttcacatagcgtaatcttttaaaatggtatctatattatagcccgtattagtatttcattctttctttaatgctgagtaacatttcattgtatggatataccacattttttaatctattcattacttgatggacatttgggctatttctacttattgtctgttatggataatgcagctatgaacattcatgtacaagtaccggtaattattttaaagaagttattctgggctgggcatggtggctcacacctgtaaacccaacactttggcaggctgaggtgggaggatcacttgagaccaagaatttgagaccagcctgggcaacatggggagataccgtctctacaatttttttttttaattagccaggcatggtggctcatgcctgtagtcccaactactcaagaggctggggctggaggatcacttgagcccaggaattcaaggttacagtgagctatgattacaccactgcactccagcctgggtgacagagcaaggccctgtctcaaaaaaagaaaaaaaaaaaaaagattctatagtttctgtcattgtaatagaggaggccataggatcatatatggcaagagtatatagcagtgcatgccagggagtgaaaaataggccatcaaattgaagttactgggagaacttaagactaagtctaactacgcatgagggattgaagccgggacacacaaagcttaaaattatgattcttctagagactgttacggctttttgctgaccacagacaatgaaagtttgatattttgctgtatttgtctgaaaatggaaacacacttttcccaatggcagtattcctgaggactagagttcttcacctctaaaacctctccaatcctagtttttccttttggctgatgatgaccagccactgccatttttgtcttaggttttgttagtctgtcttatttccagttataagtggttaaaatttcttatgaattcttcttgtgttgaacttttgattaatacatttagtctatagacagtaatgaattagcatctgatcaggaatttgtgaaaaacatctcagtcattaaagattaagaaactgaagccaattaatattgtcatgttctgtctcttggaacttgagcaagatacagatctacgtgtcaatgacatatccagaaaatagactccacctagatacattaaccctgtacccttggtccacatattttatttcagcaatgatccatggacatattataatttgacagtttcatcacatacctagcgtattgggtcaaatcaaggaaatctcatcctagtgatcttaactcagtgatttcattttgcccagatgttcagctgtgataaactttactaaggcacagatgatggatgatacacaataattccaaaatttgggggtggctacaatgtggctaggggctagaactcaggtatctacaggacaaatactgagtgattagtcactttctaagcgctagatatgcatatgttctgccaagctcagtaggtctaagtagattgcttccatttcagataattaagtgctttctttttataggaagtttttagcacatctgaggttctaaatccaaaaagtaaataatatatagagaaagaagtaataacaataataatagtaaccaacatttattgaacacagtatgggctgggcatggttcaaagaaagtttgacatatagaatgtcgaccatactggcttaataatcctcataactgaattagtgcttaagtcagttgcccagcctcagcaagcagcagaggcaagtaagtcataaatcaagatcttctgaatccaagaccatctctcaagccttgttctaattctctcctcagccatggatggtgaaaggcaccacaaaggcagcgtgtcaaaaagtggcattgttcaacctttcccctgatggggcaaagcttttatttttttcctttacgttctttgacatctgttttaaaatgcagatatcactagaagaaatgacaactttattataaaatcccagtaaaatgtaaatgtcttatataaaacctttatactgagcaaatttcagtaggaaagggcttggaagtaaggctctgaatgttttaaagggggacagtgctaagaaatgattagaaacaagagcctggaggggtcctgccatttttactgttttgcttaaggctgacctaaaatatgcatagtcttacttctcaccctgtgagcttatccttattaatgtctttttccacctagtttaggggtatttttgaatttgtgtttgataaagatgtctaaagctgtactgtaaaattttattgtcacttttttttttaaatggagtctccctctgttacccagcttggagtgcagtggcatgatcatggctcactgcagcctcaacctcccagactcaagcggtcctcccaccccagcctcctcctcctgagtagctgagactacaggcatgtgtcacgacatatggctaatttttttcaatttttttgtaaagatggtgggggtgtctccctatgttgcccaggctggtcttgaactcctgagctcaagtgatcctcccacctcaacctcccaaagtgctgggattacaggtgtgagccattgcactgagctttattgtaatttcaagggctcaatgcaatttccagtttttaaagttcatcttgcttgcagaatttgtctttcatttaaaaaaaaactgctgattggctacatttatagctgctgtaatagttctgtatgatttactacatttgcctgaatttagattggtggatatgatttagctgcttttaatattatatgagggtaaagccagatttctttggatctattccttttagatggcaatctttgtagttgttctactttacaaaataatccctgtgtgtgctcatgctttggtatacagttaaatgtatgatactgttaagaaaacattgatcactggaaagtgaccttcatttctttatttcataaatatcattatacaactatataactacacgtagtagggaagctccatttaaagagtagatgacttacactgaaatcatttgacctttgtaaattagtttaaattacacagagattgttgtaatgttctttatcatacataatagttacgattgctagagaggcactcataaatcattgctaaaagggccagctgctttcatgttttcagcaggttgagttaagggaacaagccttgccaatttgattaatctcttatgtccattagttggttgggaagtttttttgagtgtaaatttgtatgtagacaacagagtttatattctttatgacataaaattaatcagatatatctacatatttgtagaatggggggattcttagctctatagagaataagaaatactggatggaagactttttttaggatgactggctacaggaagaaattgtagtgacagaagccatgtgtattgaatttgaattaatgttccttagggagctaccagagaaatataatttacaagataatcaagaacgtaaatagattctctgtggagtcgttgtctgatcactgacatatattcatctgtattgaaatgacttcatgactacattctaacaattagagaatcattaggggtgagatgtacgtgtataccttcaagaaaagcaaaatatgtattggtaataattgacagctgttaaaacgagtgcattgtgtacttgttaaacattagaggctgggcatgttggctcacacctgtaatcccagcactttgggaggccgaggcaggcggatcacgaggtcaggagatggagaccatcctggctaacacggtgaaaccctgtctctactaaaaatacaaaaaaaaaaagccgggcgtggtggcgggcacctgtagtcccagtgactctggaggctgaggcaggagaatgtgaacccaggaggcagagcttgcagtgagctgagatcgcaccactgcactccagcatgggcgacagagcgagattccgtctcaaaaaataaaaaataaaaaaataaaaaaaaaacattagaataacttaccttggaacagtaactctgagggaaccttgatcatttatgagaatgatctcccctacgttaatactgcatcaaaactaacattatggtatacctcaaaaagtattggcatagatgtttttaaatataagaaaattcaaatgcgtaattgataagggctaaatggctcaatttcccaacccctaacaaaaatatgccctaacacagctctgtgactatgactgcatttattagaaaacatttagtaaaaatcatctctagttcaaaccctccagcatcagttcttcttgataattctcatgaacatttagaaataccttaaaagagaattcagactcaaatcaaaaaaccttatttcatttggttgcaggccaagatacctcttttaaccatttctggcttttagaatccttatcatgacagcttgtcctatctcagagcttcaggaggaaaaactagtccctcaaaatcaagtttgctattgagcttaataagaggtttctgtatgtcatatgtttgtttagaagaaaagcacttgttcgactcatttaatcctggcctgatgaattaaggcttgaattaatactgagggaaccttgactatacatctacaaaatcaatgtgtcctggtaggcttctgattaagataacattagctcttgcttgaaggcatctttctctgctcctaccatttatccagtggtagataatatatggagtgaaaaatgaaaaagacatagctgggctttaaagcaagatgaacatctctgtgaaccagaaatgtgaaagaaaaaaaaaaaagtaagtggggctaaattagtgggctttcagctcgtgctgtagtaacagggattaaaattctccttacaaggtagtggcccaaagccaggattactatttgaaatcagagccccacaaaaacacacctagagagagacacatacacacttacacttaaaagcaacatgaaaagaaacagtttgctgcaagggtctacagcttatatgcagctatggccctaatgcatagagccgagggaagaggcaaagattcgcagttgggaaagagagcatcacagccttgaaaccaggacctgaaccaatctacctactgcctggcaatgaaatgagtgatatctctgtatcactcagtgtaggagctgcaaactaccaacagatgtggctctaaactctaagcccctgggtatggctgggagaagccataaaaccacctgagagagagataatgagtttaaaaagagaggaaaatattaaagtacacacacatgagaataatagaaaacatacacatgcatatgtatgcacatgcaaaacatcccttgcaaaatttgtctccaaatcacgatccaaaatacatgaagaaatgggatagcaccccccacccaagttaaacatcaaaaagtgaattaggctgggaacagtggctcacacctgtaatcctatcactttgggaggccaaggtgggaggactgcttgtgcccaggtgtttgagactagccagggcaatgtagtgaggtgccatctttacaaaaaataatttaaaatatattagccaggagtggtggtacatgcctgtagtcccaactactcaggaggctgagataggaggatcgcttgagcccaggaggatgaggctgcattgagccataattgtgccactgcactccatcctgggcaacagagtgagaccctatctcaaaaaaaaaaaaagatgaattaattctagaagaaagcaaaataatacactagtacaacaaagatttttacttacatttaagatgctcagaccaggtgcagtggctcacgcctgtaatcccagcactctgggaggctgagatgggtggatcacctgaggtcaggagttcaagaacagcctgcccaacatggtgaaaccctgcctctactaaaaatacaaaaattagctgggcatggtggcaggcacctgtaatcccagctactcaggaggctgaggcaggagagtcgcttgaacccaggaggtggtggttgcagtgagcggagatcgtgccactgcaccccagcctccatctcaaaaaaaaaaaaaaagatgcttaaaggcataaataaggggtaccactcgctaaaataacaagaaactaagaaacagagatggatgaaatgtaactaggtctgaaaacaaagatatctttgccaaaaaaactagtcattgaagttactaaactcaatatacaggataaattctagactttgtcctgtcagagaaggcaagggaattagaagatgatgctgagaatgttactgtgtacaacactcacagaaaaagataagaaatataaatgagcaattaggagaaatggagaattgaccacaggctctacaatataccttactagaatttagaggtttgtttaggagtgtatttgagaggtttcagaagaaaatggaggaaatggtagagaagtaatatttgaagctgtcatagctgagaatcttccagaattgaagaaggatgtgagtcttgaaggaaatgtgctcccaagagaaatttcaaacatctgggaaggaaagaaaggcctgcattgagcaattgatattctttacagctcagctttggctgattaaaatgagccttttctgttttcactggaaaccaccaaaacagaaatgtaatgtgttgtatataccaaaccatgcctcttgaacaagggtccttataaataaatcataaaagaagagccctgtggacaactaaacccacaggatcaagataccaaggaagatctctctagaaaaggcagtctcctgtcagcacctttgtgaaaaataggtgggaagacagtaatggcttgttgtaccatcttgaggtccatgtctaaaaactgttttcaaaaggaacaccatggctgccccaatctggtagaaagaaaaatttgaataggattctacataaaaagtgttgccagttagaacattttgttgaagttttcttttaatgaagagggaaaaatagaaagtaattcctatggaatgagaccttgtgaacattggatactgcttcaagttcacagaaacattgaactgattgccagttaagttctcagaaattagatttaattaatgtggacagttacatacatcggtgcacacccagaagacccgtgtgcagaatctgactgaaggtgtacttacttcgatgaatctcttctcatcactgctttgtcaaagcagattgctatgaaataaactatacaaacaactacccttgaaggctgatagcaataggatttcaatcagtacagataggagattctatttctgtagatgaaaaagatcatacattgattttctgtgtgactttaaataaattcctggaaaccttgtaatgttaggtactaggtagaatgaaaaaaatgaagcaaaacaaaacaaagaaaaaaaccagagtagattgggttttctttctgcttccatgtggagatctagccttttgaaactgagcattttggaagacatgccgtcccctgtggaatgttcattccgagtatgggacaacagaaaatatttagcagacctggtgatgagatgatcttgctttctcaaactggacaatgggaaaactcttcttggctactcactacttacatttcatctcttttctcattgatatagatctcccacatttgtggataggaatttctctcacctgatgaaatatcatctgtgaacaacagaaatctgtcatcttattttggtatttatcacaagtagaagaaagatgtcaagagttctaatcagtcactggatatcaaatatcagaaatgtcctcaattggaattgtattctcagtaaatcctaaagcatttgggaccttcacatgtgctaatactgtttatatttatttggaaattaaccaaatataaccaaaagacagtggaataaccatagaaacctttaaatggaataaaatttatggcaatcaacattattaggaagaaaaagtatactacctagaaacagtgcaagaacaacgaggatcttctgtgcatctaactatataggtctagaaatatataaagtgaattatgatagaattaaaaggagaaactaacaaatccataattatatctcaacactcatctaacaaaaattgatagctacaaataatcaaaaattaataaagatatggacaattttaacaacaaaatcagcacactatgtatttagagactccatctttccaatggaaaaatacacattatttcaagtactcaatgaacatttttagaaagtgactgtgaactaggtcacaaaaagaagtattgctaaatttcaaaggatcagtatcatacaggggttctctgattgaaacgcaattaaattagaaatgcactaagaagtgaaaatggaaatataaccactgtgctcctaaatgactatgggttaagttaaaagaaatcacagtaagaattacaaaacataaggcactgaattgaatcaggtgatgtatataaaaacttttggtatataattaaagtggtaccaaggaggaaatgtataaccctaaatgtgttcattaaaaataaaaaatcaatgacttattcaacctgtaaagcaagaggaaaaaaaagagtaacaagtaaaacattattaatggacataaaatgagaccatagtaagtaaggagcttcactgcattcttggatgtgaagactcaattattatgaacttagttcttcccagtttaacctatgaattcaatgtaattcaaactcaaaatttcaacaagcattttcataaaatcagaaaaccaaacactaaaatcatggagaagatcaaaggggtcagaatagtcaagacaattttgaggaaaaacaaagtgggctgagaaggcctatcagacatcaattgatttaaagctggagtgtgggatctaccagggatatgcagatagaaccacagactagaatacagagctcagaagcacacctgtatatttatggacacttgatgttttgcggaagcatcgttagagatcagtgggaaatagatggaccatacaatgaatgaggctggcttcatagtttatccatgggggaaaagtaaaattagatcgcatgttcacggcaagcacaaaaatagattctgggtaaattcaagtcctaaatgtgaaaaaccaaattttaaactttaaaatgtaggtgtaagaaaagattttcgtgaacaaaacataaaaagcagagaacatacagggatatgttaaaatttacatcttttataccataggatgccataagcaaagttaaagataagctacactaagataagggtagaagatcatatttgccatgcacataactaacaatggattagcatctagaacatatccaaaggtttaaaaagaaaaagacaatccagcaggaaaatgggtaaaggaagcatgaaaagccagttaacatggaagaagtctaaccttgccagtaatccgggatgtatgtgcaaattaaaatgcacccatcaggttaactaaaacttgaatgtctgataacaccaagtatttggtgaggaggtgggccaaatggaaaacctcattcactactgaagcgagagtaaattggtaaaagcaccgatttgtcacccagagcgattcggtgacatgtagcaatgttgaagatgttgctaagatccaacaattccacatcaaactatattctgtaaagaatctcttcaacaggtatccaaggagataggtataaaaaagaatttcattgtatcattgtttataatagtgaaaagttggaaacaacctaaatgtccatggacaggaaaatgttggcatattcaagcaacagaataataataccttatggcagttaaaatagcaaactattatgtatcgacctggagaaatctccaaaatggtgttgaaggcaaaaagcaactcttagaatggtatgtatattcttaaatgtgaagttcttaaatttaaagtttaaaaacatgcaaaataatgttattagattgaatcacataaaatgggtgtttttgtaggtgaaagaaaaatacaggcaaacatcagcatcttttttaagctcaacctagtatttgttgatacattcatggtaacactgggcatgaaattcagtgtggcattatctccttgagggcagcggggaggagagaatggtatggtgttgaggcgggcatgtgagggagcttctgctttggctgttaacttttctttcttcaaaaaacttttgaagaaaatatggcaaatgataaacttatcaaggggaggtgataggaacatgggtatacttactccattcttatacatttctgttgaaaatatttgctaatgtttagagcaaaccaaagtgttgatagaggtataaaatttttaatctcatgacattataaagaaatatttacaaagtgattaaatcctttgctgcttacttatctgaacataccagtcgcgaggcttttagtgtaacataaaaaattgaaaagcatggctcccttcacacaccaggcaaaagcttcaaattttgttttgttcttttagcactggtaagattgtcatcattaaaaccattcattagtgcctcttttgcttgctgttcttcggtggcagtcagatgcatctatctaccatggtatataaaatttggtgatgatattcaaattactttttttcttctttttctttttctttctttttttttcttttttacttttttgatgccaataggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaagtgaggagagagatgggatttttacaaacattcatttttccctcttaaacaaaactaaacctcagagagcactttttataggtgcaacaagcatcaattcttaagtgcttggtatgtgcctgcaaagtgatagtatcaaaggatagaagtagaggagatagaaaaactagtgtgtcttttttgtatttgtccaatattgtttcctaccaaaatggttttttcttgaccaatttgaaatacatcttggggaaaaaaacgcctaaaggtttccactagttctctaaaagtgaatatttcacttcttgaaatggaactatttcatttacaattagttatattttctggtatacctttgtgttttttttctcctaatccctaacacatagttctttaagcctccatcgaaaacctagcaagatactgcattgtaagaggacctacctggacatagttctggctttctgggaattttaaatttttcaattatgttctctctatcttgttacttaatacttcacaaagatatgaatcttccattacagttttgagatctcacatagtctcatcattcacacatgaccttctaaatcttccagttatttaatgtaatgatgtatagtctcattccagtgtagctctgatttttttctcaaatttataagggagcacaattcagatacaaagacagtttctatggattatatcaacagtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggcgaaaaaagtctaaaaagaaaattctaaaaaggtgtattctggcagctctatctggcccacagaaaacttgtataggtgagaagaccagttaggaggcaattgccaaggccaagattggtgagttctgagggcctgcacttgagagatgtgggaggagaggactgtgagactattctataaaaatagacttgccagggggctgggcgtggaggctcacgcctgtaatcccagcactttgggagggtgaggtgggcggatcacaaggttaggagttgaagaccagcccggccaatatggtgaaaccctgtctctactaaaaatagaaaaattagccaggcatggtggtgggcgcctatagtcccagctactcgggaggatgaggcaggagaatcgcttgagcccaggaggcggaggttgcagtgagccaagatggcaccattgcactccagcctgggcgacagagcaagactgtgtctcaaaaaaaaaaaaaaaaaatagagttcccagggtctggggactgagtgcaaattgtaagaagaggaatgaagggagaggatttggttggaagaagatagtgaaacttctgattgtggacataatgtgtttgagaaattgacaggtcttctaagtcatgtcccaaaagaaattaagatacagatctatacttgaagtaagtgggcaaactggagagatttgagaatgagtttcatagaattgattgctgaagggtgtgagatgagaaatctataaaatctataacacaggtgcttcgatccagtgccttggaaaagacctccatttgggtaatgggatagtaaaggatggataagtagggaggttcaaggaagatgtgacaaaaaggtgaaatgctaaagagagctcaatggaaattaaaataaatcacagtccattgggtcactataaatgcattgggtaattttgagaaaccattttaggccaagagaagggaaggtggaaaacttctgtttcaatgaaatgaaagactaggtaatcttaaaatgaatgaggattaaggaaagtgaagacaattttgaaacattaccaagtaagaaggaagccttaggcaaaagttggatgaatttgttgaggaaatggtccacatgttctgttctcattcttagcaatgttctctgcctaggactaggttctaagaaaggtggagctgatgaggcataaatgatcaaaggtcaaaacaagagtagggcattttacagtggtaatgaatggctaggacaggggttcctagccagctgctcattggtttttcctgctgtgtctggctagacaatagagggttttatgaaggccacaaatacttggtcccccttcctcatttctctttctctgtaaaggcccagtaggagtcagctccatcctctctccttacttttccctgggacctaaactggttatatacttggtcctctcaaatcttacctcacagaatagaaaagacctgtgactccttgattccatacacttacagctctattgcctgatatgatgatgtgttcaggaattcatttcatacttgagctcttccatgagggtagaataaagggaggcaaagtgccttaaccaaaatggataggacagaaaggaaaagtcaggggtgtgggtgagttttatggcgaaaaatttggagatcacagtcgggaaaattcaaaagttggatatcatggaagtaaaatactttcaagcaatttctacatctaacatggtgcctcccagcgagctgctgaagattttacttggagatcactgaggggtagggagtacagttcatggagttgatgagaccaacgttgctgagcttatcagcagaggggtgaggtccagatcctgacgacagtggtagatcaggatggaaaagatgttgaagaagatggacgagggctctgaggagatgaacatttctgaggaaagagacagggtagttgaaataaatgtgatgaagttcaagaacctggagcagtgggaagaggcacatcctcctctggagaagccaaatcttgtaggaaagccaggttttgatttttttgagaaggaaaaggatatgtttgaggttattttcctgaatttactacacctccatgatttaaggcaatctctgtgtcagattatctccctccacctgagatctgaatatagctaataaactgttgggattgtaaatgacaacacactacatgaaaaacaactgtatgcatttgcaaagtctgtaaattctgaaaacaactgagctttagtacctcttatttttttctacttcaggattttcccccttttttaagtaagtaaagcatatgaaactaagttacatattttagtggtcagattcagagccctgggtgcttagaagcattaataattatttaggtcgttgacaatggcgaataggcagcatactcgttaaagcactcaaattaaagtgcacattaggatgtggtcctgatgatctgtggagctaaaaagatcatggtagaactgaataccaggacaaaagtgctatattccaatggctaagctaagagataacttgctggcataaaatggataagctgtgttaaatttgtcctctgaaagaaaagactgaattcaagggtactttttcttgaactgtgtattaatctgttttcacactgctataaagaactacctgagactgggtaatttatgaagaaagaggtttattgactcagttccacaaggctggggaggcctcaggaaacttacaatcatgggggaaggtgaaggggaagcaaggcatgtgctacatagcggcaggagagagaaagcgaggggagaactgccacacttttaaaccatcagatcttatgcgaactcactatcatgagaacagcatgggggaaaccgccgccatgatccagtcacctcccaccggacccctcccgcagcacatggggattacaattcaacatgagatttggatggggacacagaaccaaaccatatcgaactgcataagctaacttcatttaaaaaggaaaaaagccttaccgtcttcttgaaggatgcacacaggtgtttaaataaatgcagtgtatatacttgggctttgaaggtttgagatacaaggctgggatctgctgaaccacattctggatagagctgcattctttaaatatgcaaccccgatgactgattttcttttaagtgaaacatgagacaagtcatattaggtgatgtgtctaaagagtcaacatatttcctcaagccatgaaatacttatcactgagtctctatgtaccatttgtattctgtacagttcttactgagacaatgtgctaatgaaacgtacattctattggaggaagcaaatacagaacaaaatagcaattaacaatgtttatcccctattggctctcatgggctccatatacaaatctgtgatgtccagacaactccttatctctgatgactcctaactttccaccagattactgttttttgaagcattttatattttattgatttaaaaattaaactgttcctttgctttttaaaaaatttatcatgtacatttgaggtttatgacataatggctccctagctttttatttagaacaatttcaaacttatggcaaaactgcaattaattcaacagtttgccacatttgctttatagctatttatttatgtacttttacattcatgtgttgttaaatggattgcatatatttagattaacatgtatatctgtatgttaacatatttttatatactgtatatgtttatattttatgtgcatatttaatcatattcatgcgtgtatatagtttgtggatttttttttcactgatccactcaatggttaggtttcatacataacacttcacccctaaacacttgaacacgtgccttctaaaatgaaagatattcttgcataagcacaattatcatgctcaaaaagaacaatactgttatataatgtagaatttaaattcaaatacctccaattctgccaattaatattcttcatagcgatattttacattcaggatcagtgatgtccctgtagtctcctttaatctgaagcactttcccagcctctttaaatctttcatgacattgatatattagaagaggtcgggctagatgttttgtagaatgtcccccaatttgaatttgtctgcttgtatccaagtgattgggttcgggttaaatgttttatgccagattaccatataggtaaggtatcctcagtacatcacatcaaggttttcctcaagattctccatccccttcaccgttcttcactctccctgggcgctccttccatactttggcttctgctatgctgacaactcttaagtcaagatttccagcccagacctcccacctgagcatcttctggataaaattataaataaaaatatagcctaatctgaaatcatgatcaacctttggagcatctcttccaatttcccaatctatacaaagtcattttctaccccttcttcctttacctgccttccttagctatgttccaccaccatcaatccagtcaccaaggtcagtgtgttttgctacttatgaaaaagagcaaaattcttcaattcagctacttctgcccaaatttagccctcatcatgtgttacctgaacagacaatatgaatactttcctaattggttcctctgcctttggtctctctccctttctaagctatcttccagaaacttcagttcctcttctaccattcaaattatatcatattattcccctctttaagcattttatgccttctgtttgacaacagaataaatgtgctctttggccttgagtacattatgttcttaacctgaaatatagcatcctttcttttcactcagtgagttttcttttggaacttaatcatgcattatatcattctggttttgttgttgttgttgttgttgttgttgttgttgtttcttttgtgtgagacggagtctcgctttattgcccaggctggagtgcagtggtgcgatctcagctcattgcaacctccacctcctgggttcaagcgattctcctgcctcaccctcctgagtagctgggattacaggctcgccaccatgcctggctactttttcttgtatttttagtagagacagggtttcaccatgttggccaggctgttcttgaactcccaacctcaagcaatccacccgcctcagcctcccaaagtgctgggattaaaggcatgagccaccacacccagccatgttttcagccagttactagtacttctttcttctgcctacaactccctagaacttaagctccttaaggacaggatgtaagtcttgctcattgtcgttactgtatgaggatactctgtgcaacaaacaatcagtaaagtgcttgttgagttaatattttagaaatcaagcataatacattcttgtgtacacatggaacagcccacacgtttaggaaatttagctactagtttcagtatctttcaccaccattcacaactgatcagctaataatcagcaacaacattgtacaccataatatgttaaaggtgttacacacagaatttatgtgtgaaattgaaagcatcggtcctatatcatatggaaaaaaattaattgtagccaaatgttgggtattggatacatcagtgtgctttttcttctaaaaaatactggagaaaggcaggaaatacacaagtactaagataataacacatcaagtcggaaactggttaaaatccaaagaaaaatgttggtgggcgtatttgttcatacacagccccctttatgagaaaaaataatttcttgtacacagctcctttttaaaaaaaagagaaaataatttgtttagattcagacaaaaacacaggagtaattcttgtgtctattctgcataggctgcgtaggttctggctaaaatcactttttaagcagatagaaccattatcagcgtttgaatcaaagggaagtgagtcagatgggatatcttcccttcaagaaagggatctgaaaccatcgttatatttcagaagactgaagaatatcttgccatggcaaagcattccttttcttttttctcggattaaattgagtcatcccacttcttttttcttcacttcagcagtgattaaaggagactatcatattttgctatatcacggtactatttaactttgactatgtctttccttattttaaaaaatgtttcagtgatttatttggaccacaatcagacaagccaggaagaccaaatagctaataatccaaaaaacattatttttctctttttattatttcagtagttttcagggaacccaggtggtgtttggttacatgaataagttcttcggtggtgatttctgacatttgggtgcatccatcacctgagcagtgtacactgtacccaacgtgtagtcttttatccttcacccccctcccacccttccccccaagtccccagagtccatggtatcattctcatgcctttgcatccgcatagcttagctcccacttataagtgagaaagtacaatgtttggttgtctattcctgagttactttacttagagtaatggtctccaactccatccaggttgctgtgaatgccattatttcattcctttcatgactaatattccatggcgtgtgtgtgtgtgtgtgtgtgtgtgtgtgtgtgtatataaacaccacgtacatactgcattttctttatccactcgttggttgatgggcatttaagctagttccgtatttctgcaattatgaattgcgctgctataatcttggtatgcaagtatatttttcacataatgacttcctttcctttgggtagatatccagtagtgggactgctggatcaaatggtagttctacattttagttctttaaggagcctccatagtgttttccatagtggttgtcctagtttacattcccaccagcagtgtaaaagtgttctgttttcaccacatccacactgacatctattatttatgcatgtttgtggaaatcaccttggagtagagtcaagtttaagtgttaaagcattgccatcaactaagtttaaaatcccccaaagactagcaatatgctatttgagcaggcaatgaatctgtgaagtagggataagggctgtgcaggtctctagtgtgcaactggaactcagtattttcttgttgaataagtgaaaaaagtgaaaaggtgtttttgtttttggtgatgaggggcttgtgatgacaggtattattgttagagtcagaaatattttgaggttgcctattaatatggtttggctctgtgttcccacctaaatctcatctcaaattgtaatccccacgtgtcaggggagggacctgatgggaggtgactggatcatgaagaagttttcccccatgctgttctcgtgatagtgagtgagttctcaggagagctgatggtttttaaagtgtgtggcacttcccccttctctctctctctctctctctctctctctctctctctctctctctctctctctctctctctctcctgctgccatgtaagaggtgccttgcttcccctttgccttccaccatgattctaaacttataatcatgaggcctcctgaggcctcctcacgcatctggaactgtgagtcaattaaacctctttcctttataaattacccagtctcaggtagtatctctatagcagtgtgaaaatggattaatacacctattatgttgtagctacatagtgtatgattagacaagccataaatattatatctggcttgtttcatgcccataatagtgtatcagtcagctgttgctgcataacaaataaccacaaaattctcaagttgcatatttctcattcacgcatctgttgtttggctgaacttttgctggcaatcagctggacttgacaccaagttgtggtttgggttcaggtctgttcaacatgtctctcatccttcttgggctagcaagctacctgggccatatgcttcttgtgcacataaacacaagcgggcaaccccaaccagtcaaagacattctaagcctctacttttgtcatgcccgcttacattccattttccaaagcaggttatgtggccaaatccgaatccccaggccagggaagtactgttttcccagctcttgttcactctgctttatctacattagacttcttgctgtgcttgaggaagccagtcacactctcctctcagagtctttgcatttgccaatccttctgtctggagcacttttccctcaaatacttgtgcaactcataccctccagttcttaaagcttttgctcaactgcatctcatcaatgaggacttccaagactccactttctgatgactctcattgtcccttgctagccctctcctcagagtgttcatcaccactcaagatacctatatagtttacttatttacttgttaagcctgtgtgcctccttatgaatgcgagtttcacagagagagtgtgtgggtggggtttgtttgcttattgctatatcttcagtgaacaatatgccaggcactgttcaaccatttgaacagtgcctggcatatatagttggattttaataaatatttgaataaataaatgaatcttactgtttttaaacttttgtggtttttaaaaggcattttaaaaatctgggttagtatcaaatattacaatggtattactttaacttcaggtttcatttagctgttttaacttttacaatatattctgacacagaaaatattaggcattaagcatttttcaatgagttgattcacttctactcatgcacatatgtgatgtctgatttcgattcttaaaaagagatgagcctgggcgtggtggctcacgcctgtaatcccagcactttgggaggccgaggcaggtggatcacgaggtcaggagattgagactattctggctaacacggtgaaaccctgtctctactaaaaaatataaaaaattagccaggcgtggtggcacgcgcctgtagtcccagctactcaggaggctgaggcaggagaatcacttgaacccggaaggcagaggttgcagctagccgagattccaccactgcactccagcctgggtgacagagcaagactccatctcaaaaaaaaagaaaaagagaaaaaaagcaatgcattaaaaccatcttgagaaatcatgaaaatatggagaaaagaagaaaacaagattatactctacttgtttttatactacctagaatgtaataggcactcaaaaaaatgtctgaatggatacaattatcactgccttaaaagttttccattaaagcaaagaagccaattttacatttgtattatacttggacactcatattaaagactcacagagagtttatctggaaaaataaacttggctgacatcattaggtttatactttataatttgatctttgaaataattcaggaacaggaatgccagtcacttcattgaactgtacctgaattttaacacagtacaattgagttcctagagctccaatatgatgtaattaaactgtcagaaatattaacatcgatgttcatgagcgtcgttcatgatgttctcttggttctgatttattcagtgaggcatactgtcactgaagtggacttactgccattaaaaatgcctcatgtttcccagttccgcaaaaatttgcatcagtaatgaaacagagagatgtaatcagccctgcagttgtcaggatcttgatcctcttggtagtatttcattcatttcatcttcaccagataatggtagtttaaaaccgcaagaaaaatgaaactaaaaatagtgaatttcacttctttttctaaaggcataaacttaagcaaatagtgcatgtgtgtgaggggggaggaagagagagagaaagaggagagagagagtttgtaactattccttttctgctttgtgaccttaattcttcagcacccatttcctgtacttaatattgcaaagaggtttcctgtggtatgttaccaggagactcatgtagtctgaggctttttatctaccttacgttcttatccctccattctaataaaaatatgaagcctcacatccacctagaatatgattttgtcttaatggttagcattggcaatgattcttttagcttctgctgttaaaaaaaaaaaaaggaataaatgcaggattctaatcaaacatgaaaatccaagtggcatagaccaaagggaatgagaagcatatttaagtcatttagtcactggcttccgaagcagttccaagtcagatgtaaacctgaggttgtccctaattaagttcattatggttgacttgctaaagcaaggtcttgttttagatggaagtgacaatgtgcaaaacaaacagagcttgaatagaagttattttcactattggaagattgtatattatgaaaagttagtttcaaaggacctttaaagtttaattttgtttgcacctaagaaatttccctttaacttgcaaatgctgtttgaagtgtatttctttaacacatgaacaaacaatacagacacagattcacaaaatctacaaggagatttccattcccagtgaatatcatccatccataggtttctttgcttccagatcatcattctctcctcacataaacagtcaaaatgtttgtaatgtcttctttataaaacccaaaacataattatgataaagtagtcccaagtaacagaggaaaggaccataactctccaatatatgccatatctacagtttttagaatattcatatttcattacctatataggatatatactatttttatttctattacattggagtttaaaggtacttgagtttcgtttgtatttttggttaaatgtcaaaacaaagagtgaaaaaaagacctcagtgtctcaactcccttcttaccttcatgaagtgactgcaaagtgttcaattcttactcttttgtgttgaggagacagcactgcaagtgtgcagtaatacttattttattacatagaacaaagtttcacatttgtgaatggggcacaaaagagagcttgtcagttttacctttttcaattgactttttcttttattctttttaacttttaaatttattttttgtttttttgtttttttgtttttaaatagagacagggtctcactatgttgcccaagctgctctcaaattcctggcagcaaacaatcctcccacctcggcttcccaaagggctgggattacaggcatgagcgaccgcacccagcctgttttttactgtagtataatatttgtacatatttatggagtgcatttgatattttgttgcatacacagaatgtgttaatgatcaagtcagggtatttagagtattcattatctcatgtatttatcatttctatgtgcggggcacatttcaagtaactagtcaacttttaaaaagatacgcagtaggctgggcgtgttggctcacgcctgtaatcccagcactttgggaggctgaggtgggcagatcatgaggtcaggagttcgagaccagcctggccaatatggtgaaaccctgtctctactaaaaatacaaaaattagctggacgtgttggcgcatgcctgtagtcccagctactcgggaggctgaggcagaagaatcgtttgaacctgggaggcggaggttgcagtgagccaagatcgtgccactgcactccagcctgggtgacagagcaagactccatctcaaaaaaaaaaaaaaaaaaagatatacagtttttttttctccaagggtaatgatatagataaactactgtatggatttcttcttccctttaaagaattacttcctcattattaagcttgagggttttctttgttatttatgagcaagtgaaatgaatttataatggtgttaaaaatgtaatcatggccctttaatatctgttttctataaatgtaattttccattatttgtttttgcttttattaaggtgaggaagatcttctcagtcctccccaggacacaagcacagggttagaggaggtgatggagcaactcaacaactccttccctagttcaagaggtaagctccaatacctagaagggactcagatttgctgggatcaggccactcgcttccctacccaactggtgtgtgtattttccatatggaagccaacacgcagtatcagaatggcaatttgggtccatggtgaaaagatttgatttttaagtgtgaatttgtggtttagagtactctgaattcaaatacccgtgagggcaacatgtttccaaaaataagaataccaccctctatttgtcaagtattttacttgcttcacacattagtctgaagagttaattatgaggtgccctttactgaagagcaattattatgtgacttttacagatgaggaaattaatgccctgatagtgcctttgccagggacatatggctactacgtgctacagcaaggcctagaacaatgcctactgattggtagtggtagagattctgacttgccatctgatgccctttatatttaaaaattgtatcttactccatcatttaaatatagggacaattaaatcttcatagagtagttggttattttttacttcgatagaggaaatacaggcttagcaaagaaagacattaatatttttctttttcttcatcactttggccttgcgtattttacccccatacaaaaacagcattttaccctgcagaattttcccactggcttgcatgagcttcagatgtcttgcttcatccaagatgatgttttgctgctactgttcgtttctgggggcatttatttggtttattgccctcacataaaacaaagtcactctctcgccttccttcaacgaataaaaaggatggtggcagtcacctgtgatcaaatagaagaaaagcctagagaaacaaaagggagaaaacacaaggctttgtggccagtgattggcacctctaatgggtagcctgggagggacgggcagcaggaaatctgggctgtttgttcctctccataagggcaatgaggagggtgtattgagtagtgtgtttttcctatctttttgttcagtgtcagttaacaatggccatttcctagctatttgatgtgcaagtaaacgttgtgcagtgcacattaaaagcaataatgttctggtagagcgttgctaaggaaccgtcaggggaagctaattttaaatgtctgcaccagccatcttttcactgctgagcgccactgaagtgatgattttaacagataaaaatcttatctgtcttccacccacctccacatcccccaccgccacccgcatccccattctgactatcttaggtatctccttcttctagatgtcataattcataatgagaagatcatacacaggcttgacagaatcaggtgctttcacgtgtctcctcattactttgtcctgcttgcttttactagcacctactacgtaccagtggaggtagtagggatggaaagaagaaatgacaaattccttgccttcaaggtacttatggtcaattgcagatacagaactccaaagaaattcaaatcacagtacaatcattgattactgtatgatcctggccccttgaactggcagcttgcttacctgctctggaaagttgctggctgccctgttggcaccctgggcatttcttccacatctaaacaagaggttagtagagaagaagctacagcaaggctcatgactctgcttcttcataggcagccttgacttcctagactcctttttgtacctgagtttctggtccaccctaattagctgtaaggtgaaatcctttgcaccatctccctgtgtcccgcttttagagtccttaaagctagataccacatgggtgtagaagcttcctggaagacaagaaatatacctcctctgatatggtatttagcagtcagtatctctgatgttgatttacttacttgtatggaaacttgggaaactcaattcaggccacctggatagtgtttactaaattagtgcttacggaagaatttcaggccttaagggctgatttaagttctcaaatgtgggagaaggaagccttgtccgataccaattccattaacttaagttccggcttactcagtggtacccttgtggcctgagaaaataaattcacattcttaaaaaacaaaacaattaaatacacaaaaaacacaagagagtagctaaggtattggaaaatctggcctatcattctgtaataccatgatcttggcatttcctcacgttttgctactttcagctaactcaggctttcttacaggcctttttctccccaaattcaagtggataaaaagtttcattattgtaaaaattaggctaattattgatgcactcaaaaaagtggtttttggatgctttctttccaactaaaagcacttttgttttttaattttgaaaaatggcatatgtgtgtgtacacacacatataccgtcaagtttggcgggaacatcttaccagttggtagatgtgttcagctgatattaagcagaaattcttgagaatcttaacatcttgggattacaaagtctttcaaatggaagagccttgaaaggtcattttaacacttttgacatccaggacagtgatttctgactctgttttgatggttatccatatcagaggaacattttacatcacaaactggggtaaagatataaaataaattgtacatgtgtttatgtacacacatgtatatatacacccaccatatgtacacacacacatttacagtgtcatatgcatacaaagatcagaaacaaaagtttcatcaagtgatgccttccatactacatacagtgcatgctgtttttctattttatttatttaaaaacaaaatgctggttgcaacccactaaatggattttctgaaccagtggtttaaaaatactaatctatgtgatctcagtttttcttgcctggttgaattatctttcaaaaaaatttaaattttgagatttttgccgtggaagtttctgccaagacgttgctaatgtctcagagacctttatagttttattctaacactaccatccatgttctcattgttgtgttacaaaaaacaaagttcatgattgctacagctgttttggacagctgtttgagtaactcaaaacagatgtgagagccagaggtctgacatttagtggaaatgtgctattaaataccaccgcgtggtttacttaaccctgctagataattgcccacagaggaaaagccgtttttaaaaaacttatgctcttcataaacataaagtatatagataggtaagctattatgtacctcaaatttacaacttttctgttgccccttgccacagagttggtcctgaaggtgtcagctaacctttctttatcttttattttcacaaagagtacctggaagccaagaaaagtcaagtgccttatttatggccattcagcaggttaagttaggcttctaatcttatcttaatggctttgctaaactgttatcaaaattaataaatgagtggcatgcttctccatttagtgataaaccgatggccaacactatcctgcataataggcaatataagcaggagcatattcaagatatgaatgtgtaaacattcagctttgtgattatatctttctggttggtctctagatatacttagttgttcacaaacacttgggagatttgagtggctcagtgtatatttgaacactgaatattagccaatttctatctaatctgtctatctctaatctcttcctttgtaagtatatgtgtagaaattgaattatagtgtaataagtcattatctactttactataaggtactctctaaagctctgccattctataggaaaactacatgggtacaataaacaaacgtaatttaaaaaataaccccattaagtgatttgtccataagtctctgatcatttagcagactaacaaagatatttttatatgtatgtgcattgatgaaagaaacgctctcctagtcagtagtatggtattaggctctctaaaatgtggtaccactttatatagatgaatgaataataggagccaagataagctcttaatgcagtaaaacaatccagaaagcagttagcagtgctactatttctgctacctgtacaatctcttgcctactgacctgtgccacattatctccaccagcccatgccatcctctttttttcataccatcccctctcaaataagcccgcgtacattctatcaaatacccctaaattaccaacccaacagctttgtaaaacctaccgtcttttaaaattaaaatcttattctgtggttcttttatggaagagcaacataaagaacaaaggcagatagaaatatggtgtgccctttttcaggcaccattctgtttcctgtatgctcccacaaaggatttgagcggttatccctttaatccaggactagcaaactacatacagcccaaatgccaaatctggcccaatacctgtttttataaagctttattggaacacagccatacccattcatttacatgttgcctatagttgctttctcattaccagggcagagtagttgcagcagtgctgaatagctggtccagagaccgtgggcttgcaaagcctgaaatatttactatctggccctttatggggaaaatttgccaatccctgctttacgctattatttcgttgtccattctgactcattacatgtatagagtcacaggcttctgtgctgatcaactttcagctgaacaagattattgagctgaaattgaattgatttatagatttatattcatattcaccaaagagcctgcaagtgtggccatttgaatttttttgacttataaaataacagaaatcctaaaaagggacttattcttccttaagtattttaaatagtcagtgaattaatataaaagaggctaaaagcacccagaaacagtactgtcctgcaattccaactctaaaataatgaattacaatcaataatgtcaattttatagtgcccgaggaaattagacttctcgggacctgaccaagccctttatttagactcaggactgccccagcacacttcccttttgtcttgattcatttcctgacaacacatcacattgccagatggacactgtaactgaaggtctacagaaactcatttccaaaaaaaaataaatgtttagaaaatgaaacatatctgaaactttatttatcggtcaagaacttttaaaaatgttgtaatcaagtagcctctgttttgtcagcgtagaactagtccttttacagtagaaaatatcatttgtttttaactttttctaaagtgaaaaaaaggaccttccttttgtaatgtgttaatgagtacgtggggacccaagtgatgagggaggattttagaagagattagagttagcttggctctgggaggtccattttcataaaatatggtttctgaagaaggatctggaacataacacaagtcatttgctgctacatattaagaaataatcaattgataactgagttctgaatatggcttagtgtagaattactaaagatatgtatcattaagcattcaaagaatcatcgttacattctgaagtacataaccataattacattctaaatcacatggctttctaacaacactgtccttcctaaagatctcaagttttcaaaactagaccaaagttacatgccgaaacaagttacccacctttggcatccaaactaaagtgtgccagtgaagggcaagttacttataacacagaaggactcctcttggtcatgacccaactactactttaccaattcacttcagccagtatttatcaaataccaaaagtgtgtatatacggtacagggcattgggcatagagaggtggatgagcaacatgtggaccccgtcctcaagaggcttatagtcttacaggggaagggaattaattctgccaccagacagtattatgaaacataaagatacttttttaaaaaaaccttgctaaaggaatcaaaaagaaggggtgagtgattcatactgggatttcagccatcaaggaaagaatgatgttctcctccccaaatgatgggaacatcatttggtatggatctcccactagtgacacccacagctgaggagctagtacccatttttctccctcttttccctggcttgaggagcatcttaaatacctggcccttacgtggtcaagctgaaaatctgatactcctaagaaatcgctgagtcatgtaggaaattcagaaggaagagaggaagggagagaaggagaaagggagggaagaaagagaaggagagagggaagaaaaacttagaaactatccttaaatgtatactagaagttttgaaccctaaccttgagtgagttttgaaaggtttctattggtgtcgtagctccatacctcttcattccagactagtagttctcaaattgtttcagggagtttttagtcttcttggagccactgagaatgatgggtggaggggaaagggagatgctgtacaggatctctcacagctctgctttgaactgctcaaaatattggaattccatataagattgttttaggagatgtcccattgctatagttaaaacagtttgaaaaccaagattttaaaggaaattgcatgcccaagacaggctattgacatgtatggacagaagtccctacttttctgtccaattatgacttatcatagaacactttctcatcagagtctacttttgaaatacaaataaatgcatacagatgtaggaatctatgaatcaaggccagtgggtctttagccattgcctcgtaaggctcctgatatttgctgaattggggaggaagtggaaagctcattcctggatctggctctgtggcttgcccattactgggacttacctcttcccctcatctgttctttctgttttctcaaatgcctccaatttcatcatggaaatgctcagcttctatcagatagaacaaattctcccaagaggatggagtccagcctctatgtcgggttctaccttgcatttgatgtgcagactttgggcacacagagtcaactactgtttatgtttcaatgtgctgattgtcaagagtgaagagattctgagactttttttaacattaagtttgagttgtccttgaaaacaatgcccaatttgtcagatttctattctgtgccagttttcatccagtttaatgcgtgaactctatggattttacaaatgacgtcttctggatcatgttatctgtttacactgatcttaagtgtatgtaaaggttatttgactagatgtgtcttttgggttttttgtttctgtttttttttttttttttttttccagcagagaataaatggtcatctcaacatttgtttggtaaaagaagcaaattggtatgaaattgtatatttatgcatgttttttttccctttctgatatctctgcctcttcctctctctattattaaaggaagaaatacccctggaaagccaatgagagaggttagtgagattcaggctcacggccatggcttctgtctgtctcatcctgctttttatgtttggcgtttgtgtaagaattgtgtgtgtgcacgcgcatgtgtgtattacacattgtgtcatcatgtaaggatggtagtcacctctccacttgcagctcatgaggaacattcctcaaatgttcattgccgttgtcatcaccatgacgacaagactggggttgggagcaagaatctctttaaaatggcaatcctttgtagtccctaggttggaatcctgccgttcatcatctgttgccatttgcaacactaacaaaatcttcaaaataaatttagccttgaacataactgatgagtcataaagctttcttccacttccaggaccttagcattttctgccagcgcccttagtttttattcttctgggatgacttcattttgcttttgtttccttttttcttggttcctacgctctttctctcccattttagcgaacattttttgagcacttactgtgtgccaagcattgttctcagcacttgccatctttttcatcatgtcatcttcatgacaaacctgtgaggtaggtactcttattaaccccgttttacagataaggagactgagtcaatgagagagtaagcagtgtgtcccaggtgacagagccaaggatttggatccaggcagtctggctccagacccacactcttaactctcatttgaaaggcttacatcatctcaacgtacccttcagaagatgatcttttttatttggtatttgaagccacacagaacaataaccaattcgattaaaaaattaaatattggagttttgagaggtttttaaaatgcctatttatgggttgaaagggatagggtgcagtcttatcactgaatgtggtttcaggttttacggtgaaagatgcttcttactcctattccaccaggaatattgtctgaatatcgaattacctaattaagtgactgttggatgacaaagtgttaactgacagcccaagtaaaatcaaggttgtctttaccaagaatttaatctgaaggaggagagaaggaaagctctcccatgggatgacagtgttctgggagacaggctggatgggtggagagtccttcttaaatgagaagattctggattccttagcaacaggatggactggagagaccactgattcatttaaacacaggagtcgtaatgaaaactctgccaacatcatgccatacaagtctaatcaatttaatgattcttcagtgtgtctgtgccagtgcctccttccaaggctttgggcagtggggccagggagggaatggtaggctgggaggagaaattgaggaaacctgacttggtgaagcattgaatgcccctgacggtttgcctggttcatgtacttcgtatgtgagacttcttgggttcattcttatggtaagtgccccttaaaatttattcattttaactttttgtagaaaaatgcaccataattttgaccaccttaaacatgtttcactcacaaatgaatttcagaaaaggctagcacatgtaattgaagttatataggcatttgcagacttgactacctgaggtgtatggtgttcagacaagtttccagaagccaaagaatcaaaacaataatgaccttttttaatgctatgaaaatatcccaaatgtacgtaaagcagatttttttcagagattaaattatagagaagaaaagataagcaaatttccctgtagtattccggctttcctttggacaactgaatgctaacaatttatttgggaattgtatttttaaaaaatagagcaccagattgctattgaggtcttggatctttgccagaaagtctcaattccaatcgctgtggaaaacaattccctcaggcagtggtgacgtgtgagactaaatgtgttgcagttagcgccaacttgaaaaacatacaactgccctaatgttcaaggcatagtgcctttgtgttcaataatccttaagaatggattaaatcaatactttctatagacatagttttctgtcaccttgtgcctgaaggtgattgcaaatgcctgaatcctggctgcttttcagtacctctcatacttcatagtatgagattgtaattttgactttagaaaaatctgtcaggtaacattaatgacctcccgaatgctctgccttacacacatggataatagaactaggatacaaatctactttctatagtcatgtcacagtgcagtcttacccctccaacggattaaagtatgattctttagggcagtagtttgtaaaaagagattgacttcttttttctggatctaatgaaaaactccatggaaagaaattagaattatttattctggtaaagcaggtatttagtgaagtaaccaaaggcataatatagatgatgaggtgactctaaaagttctttatttttatagcacaaagatggccacaaggtcatttgtgaaaatgcagcagtgtaaaccggttaaaggccacccaactttttgtcggagtgtgcatggcacattaagaataatgaacctgttttccctggcaaatctttaaatagcagatacccctagaacttatgcttcttgagagactcaagaattttccttccagttagtaactgaacaccatttcaaggaagagaagcaccacttggctatataatccataaatgcatttatttgttttattatattttgaactgccatctacatcccctagcacacagcctaaaaagaaagacactttgtgattatcgataagctgacaggaaaaaaaatgagttttctccccttttcgttgatgttttgtaatatgttttctagctactaggtggactacatactatagtcacatgtgggccatgagaaatacttcgaattacattcaggcaccatgttgtaaaggtcctggactttgtttttactgattttgttaaccgtaaagatcgctagtaattaaaaattggcagttagtccatctatcttcaatttatgcatgaataattatgcagatttcccagggttgctggacagccaaaaatagatacaggggaagccctccaacttgatagcagcagttatatatttgtactctgagctctaaggagcagcaaaggccccactgtgtcgtcttcctgtggtttttatggcacagaaagccaaaaatgatttcagttcttcactgagggctgccaaactattggcccactttatgaatagttgcatatgctttgttaaaaaatttttatacttgcagtctcagccaaaatccaaagtgattttctaaaatataattaatactccatgaaattctttgcactaataaagcacaaaaagatagatatacaaacttggtcaccttaatagaaatgcctgaatgacattaaacttttaataagtaagtcttcagttgatctggtgccatcactgtttaagtgcctgcccgtgaatccgcttcattttgtagagaagctatatctcttgaaataaatattaaaacaaaatactctccctagtctatagctttaatttttattgggatatctttaatttttattggtatttttaacaattattatgggaatctgtaaagttgatacatggcaaggtagtaatagcctagtaaagcatttcagttccaaagacaatacttgaatagtggaaggatttaccaatgtgcaataattaaaattagccatgtaaaactatgggacatagacgaaaaggcaagccataaagtaagtctcagattatcttactctaaatctgaattttgctacgaagtacccagggacattgtgctgttctttttctccgtgctgggagattcgtgctaggtcgtgctgcattattagtaaaaggctattgtgatagttaaccctcatttaggaggagctctaagatggattcacaaaatacccaaatgcatacaatacatgtgggtcaccttataattagggtctagagtaatttggaatgtaaagcaatttttattctgaggtttcctaattcaaatgttaatagtgcaccaaaaggtcaattcaagagtttattattattatttttcaacccaagtaaaagcagagagaaaatagccacctccaccatagcctcagaagcaagccaacagcctgaaacagctttgaaatgaaaagttggtgtggcggtgatggtggcagtgataatggtgacgatggttgggtgctggtgatggtagtggtagttgtgaaggtggtgatggtggtttgattgatagtaaaaaaaatgttcgttaatacaagtagagagtaagtaatcaatcaatcactcatagccaaggtggaaaagatgtatcccatcatggaatattcctgttctgatagaaatcttgtgcttatctatggaattcttttgatatatatttacattgggaacctgaatgtagcttgacatttttccatgtaaacaccagtagcctgatccaacattaagctgatactaacaaacaacgtgtaatggcttcattaataaggctttgcttcttcctggaaactggtgaaaaatcaaaccttgttgtgtacaccctcgatgcagcttctgtgttgtcttcacccagaaatggggaatgatttcccaaatggcaaagaaacagagtgatgctatctatctgcaccttttgtaaagtctgtctttctttctctttgttttccaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtattgactggactgcagtactttgtttttattttaatttagttgttgttacttacttacttactttttaaataggtaatacatgcatatgagtaaaaaactataatccagaaagacagtgaaaacactcctaactaccccttcccccatatcaatcaatcatcctcattgctctatgagtagacattattaatttcttatttagtcttccagagggtctttctttattaattattatataagcagttaaaataatatatatgttcctatttatttttttcctattattatttcataggatatagcattctctgcacccagttatgcaccttacttgtttgtttgtttaaatttaaatatggactcaagaaatcttttcatttaaatatataaaatgctttctcattcttttttatagctgtataatatttcattatatgttcataggatattttatttaagcagttccctttggtgggatatgtagtctgttgtcagtctttcttttgctataacaaacaatattgcacatttctcattacatcatttcatttgtgcataaacaaacaaatctgtgggatacttcctagaagtgagattgctggatcaaagggggtaagcatttgtagactgggagatgatacattttgtgcagtgattgattgattgatagtcatagtgtttgtttgtttgttgtgttttttgttttaataatgacaagtatattaattaagtcagtttgcagttcatactttgcttctcaagagaatttcatatcacttctattcttaatgtcaccatctaagaggatgcatgagtgagtagtaagaaagagacacctaaaatgatgtctcacaactggttctggggaagaagaatcccttaccatagtcaaccaccaccatggggagaacctctcctttgcccctgccctgctctgtttcttgccctagctgcaaaggaagctgagaaagtgggtagcaatgtcagcacttcttagggagaggctatctatctttacctattcccaaggttcatggatggggtgggcggggttccccaacagtgttcagatactggtgagccaaaggaataacataagtccaccaggtgcagcctatcctagtgattttggaaataataggagatgagatgatccatctcattagaaatgatgtttgttagtagatgtggcatctctgctgtgaatcaatcacttgctaattttttgaaagtagggtgatgatgctgacctaagtgactaccacattgaaacacttcccttgacatccacacataccaagaaaaattttcatcctatttaaataaacaaatcatttatccttcccaccattacccgaacctacctttgtttgaaacacccagactggctgttttggtgacacttaaggaggtaactgaggaatcttcaatacttcaccacgtctaagacaactgtgtgtggatgactctgaggagggcatttggttttccattccatacttggcacacactagaagagacagaattaattcagttaaaaattaaaatgaatcgagctggcacagattatgcaccggcaagcaaaatgtgtgtttgtttgggagaaagcaccaagactaatggatgtgttctgtagagctgcgatgggatttccctgaatttgtaatgctctaatggtggaatgaatacaaaggcaggcactggcgcacttgcaaagactttgccttcaaattaagtgtaggaaggacacaaatcaaattctttcccacagtagcaaagccattggagtaggaactataaatatgttcttcaatgccccttgcacgtcagtgtactgtgatctcatggacttagctgacaacacaagagtggcagcatgcccaacattccataataaacaatattgtgtgaatgtgtaaagtttggggatgtttgtttgagagtagcttttgtgtacagaaaaggttacctacagtaacttgaggtttaaatgttatatgtacatatgtgtgtatgtacatgtgtgtattttatatacattcaggattttagctcttccataactttattttgaaataattcaaacaagaaaaactgaaacaaaagaaaaattgcaagaacagtacaaagaaagaacccacatataccctttacccaggttaatgaattgtttacattttgcttcatttactttatcgttctctcaatgaatagatgatagtttttcctgaaccattttaagaataagttgtagacatcatgcctccttacatttaaatacatcatgtacatttcctaatatctaggacagtctcttgtataaccatagtacaattatcaaaataaaaaaattatatatagctatcatctactccacagtccatattcaaccaaatattgtcaattgtgccaatgatgtctttcatcattatatatatttccctagtctggactctaattcatgatttcatgacatttagttgtcatatctctttaatcacctttgatccggaacagtgtctctgcctttctctgtcttcaaagaccttcacatttttaagagtacaagacagttactttgtaggatgtgcatcaatttgggtttgtctgatgtgttctcatggtttagattcagggtatgcatttttgtcaggaatactacacaaacaatgatgtgtcctcagcatgtgataccaggaggcatattcccattcttggtgctgttaacactgatcatttggtaaaggtggtgtctgccaggtttctccacttggtatacattttaaaacctaagttttcataaatctttaggttcaacttagaaatttcatttttagatatataaatgtagacaatttgtatgaagtaagaacagtcacttttagtgagcagacttagccacgttgagtagtctgaattttttcgttctaagctgtatttatacacttaatgtgctttattttcaagcctatctaatatctcacagggaagaccaacgccaaccaacagcacctccaccatacctaactcacatatatcgagacaaacatataaatatagtgaatctcaagtcctctgaaacattccaatagcatatactgtatgagctgagtccaactttttttattcattttgaaataataacatgtgtaaaattacacattttacattggaacctaagacatctctccaatttgctaatatgtcaaattgccacaaacatcttaagcactttaaacgaacacagattatgcctaaattcaacataaaagtattaaaaccaagggttaggtttactccaccatctctttgtttcattttaaaacttcctaggctttcaagacttatttgataaggtgtatattaaaatgtgacccaggtgtgttaaagtctttgaatctcatagttttgagggtggccacatgaggtctgtagccttcagcctcctgcagttaatcaaggatgcccttcaattgataataaatgtatctgtgtgccacaacgtgaaaacatttgggaaactctgcacgaagagaatacttttatcatcacaacaagagttgaggttactggctcaacaattcctatccatactaaaattaagcatcctgggcatgttgacaatttttatcagccaaaaatttgtgactggactgagtaactcttttgatgccacagaaggataagcactcaattcctttttaaagtcagtacgacaattgggggactccaagcctgtactttccagatacgattgatttcacaccctgtgttcctgggttcaatttccccctttatacctgtgtgggtagctgcaagctcctatactaggactcccctaagtcctagtgtgcctgcttcattgatggctacatctttcatcatgacatcattatcaatagcaccctttcaatctcaaaaatgcccttcttagtaggtacacctaatgtctttcaaacacactgtttctcaatagaaatgttgttggtatttgggttgggacaattcttcattatgcacaactgtccctcactttgtagttctcccagtcattttgatgacaaacctgcctcaatacattcccaaatgcctcctagggaagcagtagaaaattgctgattctctttactgcctgaatacaggctgtgttcttttcatactctccctaactggcaagctccagctcttagagatattttaatggcattagttcttgcatacttttcctattttgtccagccctccagtcacttctctaaagtaatttaatgatactacgctagctgaaaacattgaccatgagataaaagccagcaaataaaagtatttttcgacagtagagaaagaagctatccccattcatttgcattcatttaaatgtaacatctggactcttggtgcgttttgagcttgtagatacaccccagccacatcccctcttgtcttcagagacagtgcatccatgccctcgcttctgggaatatcagctgctgatggctcacaactgtgtccctctccggacacccc
